United States Patent 10,767,156 (POLYNUCLEOTIDES ENCODING BREX SYSTEM POLYPEPTIDES AND METHODS OF USING SAME) - sequence listing, part 10

SEQ ID NO: 6219 - DNA, 4643538 bp, Escherichia coli (residues 3,095,693-4,643,538 of 4,643,538)
caaggcttgtgcatgagcaataccgtctctcgccagctgcaaggcaataaaccacataacacatcccacaaccagattgataatgcgctgtgcttttgccgtgcgcagacgcggtgccagccaggctgcgagaagagccagaccaaagaaccacaggaaagaggcgctaattgtcccgagtgcaaaccagcgttttggttccacatcaagttgcccgccaaggctgcccagtacaacaaaagtatccaggtaaacatgcggattcagccaggtcactgccaacatggtggcgataattttccatctgccttgcttcatgacttcggcgctggctaactcaatattactgctcattgctgttttaaaagcgccaaaaccataccacagcaagaaggctacgccgccccaggtgaccagcgccagcaaccacggcgactgcatcaataacgcgctgccaccaaaaatcccggcgcaaatcaggaccaaatcgctgatagcacaaagtaaggcaatcataatgtggtactgacgacgtatgccctgattcatcacaaaagcattttgtggaccgagcggtaggatcatagccgccccaagtgcaagaccttgaaagtaataagaaaacacgttggatattccgaattaagtatctgatgcagagactatatcgcgggattgttattagcggaaattgataatattaattggcaatcagaaaaactaataagagagaggccagagagtattatctggcctcagcgttgattacgcagctttgtcttctttcacccgcttaaagttcacatccatttgcgggtacgggaagctgataccggcggcatcaaattcacgtttaatacgctccagcacatcccagtacacgttttgcagatcgccgctgttgctccagacgcggaccacgaaattaatcgacgatgcaccaagttcgttcaggcgcacagtcatttcgcgatctttcaaaatgcgatcttcagactggataatattggtcaggatctgcttaacctgatcgatatcggaatcatacgccacgccaataataaattcgttacggcgaactggctcgcgggagaagttaataatatttccggcaataattttaccgttcggaataacgataattttaccgtctgcagtacgcatggtggtggagaaaatctgcacactcagcacagtaccggctacgccgcccaggtcaacatattctccggcacggaacgggcggaacatgacaagtaacacgccagcggccaggttagaaagtgacccctgcaaagccagaccaacagctaagcctgcggcaccgagtacagcaatgactgacgcggtttgtacacccacgcgtcccagggctgcgattagcgtaaaggcgataataccgtaacggactaatgcagaaagaaaatcagcaacagtggcatcgattttacgggagatcatcaggcgattcaccgcgttggaaatcatccgcgcgataatcaaaccaacgatgatgatcgcgagtgccgccacgatgtttactgcataacttagcagcagcgcctggttagctaccagccagcttcccgcgccgtttatgctatcgacaacattcaaatcttccattcaatattccttttcaactgactcaaaatggagaaatacactccgccgccttatgacgggcagtctgacaagggtaaacaataaagcataattttgccaaatagatcacagatttctcatctgaatcaccttgcttttggcgaaaaaatccccgcagagcggggctcagacagatatcaatgtgcgttttgtcatgccggatgcggcgtgaacgccttatccggcctacaaaaacctgcaaattcaatatattgcaggatacgtgtaggcctgataagcgtagcgcatcaggcaattttgcttttggcgaaaaaaagacccgcagagcgggccttgagataagcagaaaggaatatcttacagaacgtcgatcgcgttcagttcctggaatgctttttccagacgagcgatcatcgaagtctgaccggcacgcagccatacgcgcggatcgtagtatttcttgttcggctgatcttcgcctttcgggttacccaactgcccctgcagataagcttcgttcgctttgtagtagttcagaacgccttcccaggttgcccattgggtatcggtatcgatgttcatttttactacgccgtagcttacggagtctttgatttcctgagcagtagaaccggaaccaccgtggaatacgaagttcaggctgttgtgcggcaggttgtgtttcttagaaacatattcctgagaatcacgcaggatggtcggagtcagaaccacgttacccggcttgtaaacaccgtgtacgttaccgaaggacgcagcgatggtgaaacgcgggctgattttgctcagctcggtgtatgcgtaatcaacgtcttccggctgggtgtacagtgcagaagcgtccatgtggctgttgtccacgccgtcttcttcaccaccggtgcaacccagttcgatttccagagtcatgccgattttggacatgcgctccaggtatttagagcagatttcgatgttctcttgcagagattcttcagacaggtcgatcatgtgagaagagaacagcggcttaccggtagctgcgaagtgtttttcacccgcgtccaacagaccgtcgatccacggcagcagtttcttcgcgcagtggtcagtgtgcaggataaccggaacaccataatgttcagccatctggtgaacgtgatgcgcaccagagatcgcgcccaggatagcagcaccctgcggaacgtcagatttcacgcctttaccagcgataaaggaagcaccaccgttggagaactgaacgataaccggcgctttaactttagcagcggtttccagtacggcgttgatggagtcagtaccgacgcagtttactgctggcagtgcgaagttgttttcttttgctacctggaaaactttctgtacgtcatcaccagtgattacgccaggttttacgaaatcaaaaatcttagacatgtctcttgtcctgtatcgtcgggccttatactcgtcatacttcaagttgcatgtgctgcgtctgcgttcgctcaccccagtcacttacttatgtaagctcctggggattcactctcttgtcgccttcctgcaactcgaattatttagagtatgaaaaattgcgtgctctaaaagcgcgctgaaacaagggcaggtttccctgccctgtgattttttacttcttagcgcgctcttcgagcatcgctactgcaggcagtactttaccttccacgaattcgaggaatgcgccgccgccagtggagatgtaggagattttgtcagcaatgccgaacaggtcgattgctgccagagtgtcgccgccgccagcgatggagaacgcttcgctgtctgcgatagcgttagccacgatttcagtacctttgcggaagttcgggaattcgaacacgccaaccggaccgttccacagaatggttttcgcattcttcaggatttcagccagttcctgagcggaagcatcaccgatatccaggatctgctcgtcagctttcacatcgttaacagatttcagggtagccggtgcagtttcagagaactcggttgctacgcgaacatcagacggaaccgggatgttgcaggtgctcagcagacgtttagcttcgtcaaccaggtcagcttcgtacagggatttacccacatcgtggccttgtgccgcgataaaggtgttagcgataccaccaccaacaatcagctggtcagcgattttagacagggagtccagaacggtcagtttggtagatactttagaaccaccaacgatagccaccatcgggcgagcaggttctttcagtgctttacccagcgcgtccagttcagctgccagcagcgggcctgcgcacgcaacgtcagcgaatttaccgataccgtgagtagaagcctgcgcgcggtgagcagtaccgaatgcgtccattacgaacacgtcacacagtgcagcgtattttttggacagggtttcgtcgtctttcttctcgcctttgttgaagcgaacgttttccagaacaaccagttcaccttcagcaacgtcaacgccgtcgaggtaatctttaaccagacgaaccgggttagacagtttgtctttcaggtagttaacaaccggcagcagagagaattcttcgttgtactcgccttcggtaggacgacccaggtgggaagttaccatcacttttgcgccttgtttcagggccagttcgatggtcggcagagaagcacggatacgcgcgtcgctggttactttcccgtcttttactggtacgttcagatccgcacggataaatacacgtttcccagcaagatccagatcggtcatcttaattacagacatggtgaatcctctcgttgattctaaaagttttgcagacgctgcttgcgtcttacctgaaagcaacagtagccatagctaacgtcgtgtcgagcattcggttagcaaagccccattcgttatcgcaccagaccaacgttttgatcaggtgtgcgccactgacccgggtttgggtgccatcgacaatggcactgtgcggatcgtggttaaaatctacagagaccaacggcaattccgtatagtcaactataccatgaaatgcaccttgtgctgctttttgcagcaacaggttgacttcattggcttttacaggtttcttcaccgtcacgcttaaatcgattgccgtcacatttatggttggcacacgtaccgcaatcgcttcaaagcgatcgttaaattgcggaaaaaatcgtgtgataccggcggccagtttagtatcgaccggaatgatcgactggctggctgcccgggtgcgacgcaggtcaggatggtatgcatcaataacctgttgatcgtgcatggcggagtgaattgtggtcacagtgccggactcaataccgtacgcatcatctaacaatttgatgacgggaattatgcaattcgtggtacaggaagcgttagaaacgatgcggtgttccgcacgaagttgatcctgattgacgccgtaaacaacggtcgcgtcgagatcgttactgccaggatgtgaaaagagcacttttttggccccggcggcaatatgcgcttcgccatgctcgcgggagccatatacgccggtgcagtcgaggactacatcaacgccaagttcacgccaggggagcgattgcagtgaacgttcatgcaatacgcggatggcgtcatcaccaacaaaaagttgatcgcgttcctgtcgtacttcccatgcaaaacggccatggctggtgtcatatttcaacaaatgcgccatgcccgcagcatccgccagttcgttgattgccaccacggtaatttccgcccggcgtccggattcatacaaagcacgaaccacattacgcccgatgcgaccgaagccatttatcgctacgcgtacggtcatagatctcctgcaaggttttccctgagcaaatttgccagacagagtaatccagcaaatcgtccggggaaaccttacctgtcgcaaactgcgactgattggttaattgtcgaacatttaatcgactgaaacgcttcagctaggataagcgaaacgtggaataaaaggaatgtttgtccagccgaagaagacatttatctgactcacatcacacttttatccccttttgtgggaagctttattccaggctggcgtaataataaccctacaataactggaataaattgtcagcttgtgaagtgataccggccttcttcagtcatctctactatcagattggcctgacggctattcatcagcacacgctcgacattggggccatcggtgcgggcataaaatgcttcggctacttgccgcgttaatcctcccgcaattttacgactaatcaagcgctcccgcagaatttgagcaggtgcatgaataaaaatagaaaaatcgcagaaagatgccaactccagccacttttcatcatccagtaacaaccagtttccttcgacgatgacgagtggtgcggtaacgtgcaacgcatcttcaacaggatcatgcttttgtcgatcgtactgcggccacgtacaatccccttccacgacctggcgcagattttccgtcagtttcgcaacgtcaaatgtctctggtgcgcctttgaaggggcgcaattgatgcgcatccagccagctattgtaatggtgaaaaccatccatcgggagcgtctgaatagcgggcagttccgggtcttgttgcgcgagatattcccagaaggtggttagggttgatttacccgtccccggcggagcgcaaagaaaaaccaccgtacgccgctgcggatttaccgtctgtaaggccgccaacatgtgcagcaacggtttatgtacattttcaatctcttcgttctggtactgtgcctgtatcttcagcccattcaccgttaattcaattttcacggcgttaattcctttaaggtggtcgttactgccagcgtcagcgccgttttgaccattccgctaaaacgcgcctctgaccagacggcgaaatcggcgaacttcatcgctttcaacgcgtcatagagcgtcgcattgcaggttatgctattgacgttgctgataaaatcccaggtcatgtcatcggcaaatccgggcgtttcatcctgttcgttcaggtaatgccagaactgggaaaaatgcgtgatatcggcgtacaaccatttatccattttccccaacgcataaatcaaacgcagtgcaacatcaatatcgtcaagcgggccgctttgggcgagtaacggcttcactgcatattccacgatctcttcatcgttatcgacaaacagcgacggcagaaactggcgtatcccctggagcaaaatggtatgcgcagttttcataaatgaaaataaattgtcctgtgcatccagttgctcaagcacatcatcttctgtcagcgtcgccattggtcttccgatagatcaccatcaatgcagggagtctattatattacacgtttggtccgcgccgccgatcagtaatgtctgcgtccgcaccccattcgccgtctgttggataccgttcaccagctcaccgcccgtcacgcccgtagcgctaaagaggatatcgttccccctcaccagttcatcgagcgagtacacacggttaacgtcaacgcccattgccttgcaacgcttgcgctcctgctctgcaatctgccgattttccgtgtaatcccctttagcctggcaaaagtcaatcagctcggcctgcatatccccgcctaatgctttaacggcacaggcagaaatcacgccttctggcgcaccgccgatggtgtacatcacatcgtaaggattatcctgccagcaggtcagcacgctggcggcgacatcgccatccggcagggcaaaaaccttcacgcccagctgtgttgcttcctcaatcgcggcactcaggcgcggtttatccagcgtaaccatgcgcagcttatccagcggtttgcctaacgctttcgccacgttgcgcaggttgtccgtcagaggcaaagacagatcaatcgcgcccgccgccagccgattaacaaccagctttttcatatacatatcgggcgcatgtaacaggctatctcgaggggcgaaagccatgaccgccagcgcattgctctgccccatcgccaccatccgcgtgccttcaatgggatcaaccgcgatatcgacttctggcccatcgcctttgcccacctcttcgccaatccacagcatcggcgcatggtcaatttctccttcgccgataaccactcgtccacgaaaagcgacgtcgtttaatgcctggcgcatcgcggtgaccgccaggccatcaattttatttttgtcgccacatccggtttgcggccaggcagccaacgctgcctgttccgtaacgcgaaataatggccacgccagggacatcattgcgcggcctccccgatatcaacgccaaattgtgccagcagatatttctcggcctgttcattccagatgccgtgcgtttcctcaaccagccgcgccaactctttaaacagcggatcggttttgcctttttcggcaaaatcggcaatggcagtgagcggcatggtcacgccgttataaatgagttttttaccgccagggatatccggcagattgagcacggtttctggcaccgcatccaggccaccgatatgggtcaccataaacgacggctgtaactgcccagtggcgctaagggcaatcgcctctttcatgtcgtccgttgaaccgccagatgtaccgacgacgtgcgtgctgttgtaatggacgttgtagaaattaaacggcactttgaagtttttatccgtcggcccggcaaagaagttcagacagccatcttccgccagtaattcatcagccatctcaacgacagcaggcaccgccgcataaacaaaaatgtcatcgaacccggcatctcctgtcagcgcccgcagcatctggacaggatcgctcatccctttggtattcacatacaccagctcaatgcctttactggccgccagttccaccggcagcagcttctgtacctgcgccagacgtttgtcgtcgatatcgaccaccaccacccgcgacggttgtatgccgccgttaatggcgtaatcgatagcgccaatgcccatcggacctgcacacgccagcagtgcaatattgccgccaggtttgacgcccatgcgatgctcataaacatattgcgtggtgtgataattggcatgataagcaccaataatgcagcacataggctctgccagcgacgccgcagcaaaataagagccgtgatacggtaatacgcagcccaaattaatggcgatttcgggaataatcatataagtggcattgccgccaaaatattcgtagctgtagcccgctgaatatccgcttggtaaccccatcgccggttgcaatacaaaacgctggccttttttatatttgccagtgagatttttacccacttcgacaataaccccggcacattcatgcccggtaatgaccggatgattttctaaatcgtcgggtacgcgtttatgttcactaccgagtaacgccgctttccaggtcgataaacagacgctgtcagaaattacactcaccagtaattcattatcggtaatttctggcagttcaaatacgcgcagacggacatcccgcttgccataaatagcagcaactttggttttcatttttacctctgtaatcagtgtttatgttcggcggttaattgattaaataaagtgtcgagttttggatcgccaatatagttattaatcaatatcagtggtttatccgtcacacgtttcacgcgcccttccagactggcatgagtaacgacgatatccgcatccgcaggcacgttttctatggcgtaatgttttacttcaattgccagccccgctttttccaggcgtttacggaaggtggtcgcgcccatcgcactggagcccatccccgcatcgcaaacaaaggcgatacgcttaaccctgcttaacgagaatgcaccctcttgtttcatcgccttaaccgcattggctgactgagcaaactcatcttcgctctccgtttccaccgttttttccatcttcagtatcagcgaagtaatagcaaaggacaccagggtacctaccgtaacaccggcaattgtcgccaggaacgagcctttcggcgtcagtgccaggtaagcaaagatagaccccggacttgggccagccaccagaccaccgtccagtaagttaaacatccaggtgccagacataccgcccgcaatcatggcaataatggtcagcggcttcatcagcacatacgggaaatacagttcgtggatcccaccgaggaagtgaataatcatcgccccgggcgcagaacgtttactcatccctttaccaaacaaggtaaacgccagcagcagccccaggcccggacctgggttagaggccaccataaagaagatggatttaccgttaaccgaagcctgttgcattcccagcggataatagacgccctgatcgatcgcattattgaggaaaagcactttcgccggttcattgatgactgacaacaatggcagataacccgcatgtaccagcgcctcaatacactctttgacgaaagtattggcaattaacaccgccgggccgataacttcaaaacccagcagacaaaggagcatccccgcgatacctaatgagaagttattgataaccatctcaaaaccggcaggtatgcgtttttccagtgccttatcgacatattttatgaccaacccaccgagcggccccatgatcattgagccaaggaacatcgggatctctgcgccaacgatcacaccaatagtacctattccgcccatgaccgccccgcgtttaccgccgaccagatgaccacctgtagaaccaatcatcacgggcaataaataggtaatcatcgggccgacaattttggcgaaatgttcgttaggcagccaaccggtgggaataaataacgcagtaatggtaatgactccaacttattgatagtgttttatgttcagataatgcccgatgactttgtcatgcagctccaccgattttgagaacgacagcgacttccgtcccagccgtgccaggtgctgcctcagattcaggttatgccgctcaattcgctgcgtatatcgcttgctgattacgtgcagctttcccttcaggcgggattcatacagcggccagccatccgtcatccatatcaccacgtcaaagggtgacagcaggctcataagacgccccagcgtcgccatagtgcgctcaccgaatacgtgcgcaacaaccgtcttccggagactgtcatacgcgtaaaacagccagcgctggcgcgatttagccccgacatagccccactgttcgtccatttccgcgcagacgatgacgtcactgcccggctgtatgcgcgaggttaccgactgcggcctgagttttttaagtgacgtaaaatcgtgttgaggccaacgcccataatgcgggcagttgcccggcatccaacgccattcatggccatatcaatgattttctggtgcgtaccgggttgagaagcggtgtaagtgaactgcagttgccatgttttacggcagtgagagcagagatagcgctgatgtccggcggtgcttttgccgttacgcaccaccccgtcagtagctgaacaggagggacagctgatagaaacagaagccactggagcacctcaaaaacaccatcatacactaaatcagtaagttggcagcatcaccgggaaaccggtgttttgaaaacagtgaattattaatttcttatataacattgagttatagatataacaacaaatgtcaatacgcatatcgtgatgcatattacataattgatatttattgcatataaatatttgtgatctacaacacgccttatctattgcttgtccgcaaacggacatatcaaggtaataaaaaaggtcgccgaagcgacctttttacccgaaatgctaattacagcagttcttttgctttcgcaacaacgttatcaacagtgaagccgaactcttcaaacagcagctctgccggagcagattcaccgaaggtggtcataccgacgatagcaccgttcaggccaacatacttgtaccagtagtcagcaatacccgcttctacagcaacgcgtgcagtaaccgctttcggcagtacggattcacggtaagcagcatcctgcttgtcaaatgcgtcggtagacggcatggacaccacgcgcgctttcacgccttcggcagtcagtttttcgtaggcagcaacagccagttcaacttctgaaccggtagcgatgaaaatcagttccggctgaccggcgcagtctttcagcacataaccaccgcgcgcgatgtttgccagttgctcttcagttcgttcctgctgcgccaggttctgacgggagaggataagcgcagtcgggccgtcctgacgctcaacgccgtatttccacgcgaccgcggattcaacctggtcacacggacgccatgtagacatgttcggggtcacgcgcagagaagcgacctgctcaaccggctggtgagtcgggccatcttcgcccagaccgatggagtcgtgggtgtaaaccatcacctgacgctgtttcatcagcgcagccatacgtacggcgttacgtgcgtattccacgaacatcaggaaggtggaggtgtacggcaggaaaccaccgtgcagggagataccgttagcaatcgcggtcataccgaactcgcgaacaccgtagtggatgtagttacctgcagcatcttcgttgattgctttagaaccagaccacagggtcaggttagacggtgccaggtcagcagagccgccgaggaattcaggcaacagcgggccgaacgcttcgatagcattctgcgacgctttacggctggcgattttcgccggattagcctgcagtttagcgataaactctttcgctttggcgtcgaagtcagacggcatttcgcctttcatacggcgggtaaattcagccgcttcctgcggataagctttcgcgtaagccgcaaacttctcattccatgcagattctttcgcctggcctgcttctttcgcatcccactgagcatagatttcagacgggatttcgaacggcgcgtatttccagcccagctgttcgcgggtcagggcaatttcagcgtcgcccagcggcgcaccgtgggagtcgtgggtaccggctttgttcggggaaccgaaaccgatgatggttttgcacatcagcagggacggtttgtcagtcactgcgcgcgcttcttctactgcgcgtttgatggatgccgcgtcatgaccgtcgatgtcgcgaataacgtgccagccgtaagcttcgaaacgcattgcggtgtcgtcagtgaaccagccttcaacgtgaccatcgattgagataccgttgtcatcgtagaacgcaatcagtttacccagcttcagcgtacccgccagagagcaaacttcgtgggagatgccttccatcatgcagccgtcgcccatgaaggcgtaggtgtagtggtcgacaatgtcgtgacctggacggttaaactgcgccgccagcgttttttctgcaatcgccataccgactgcgttggcaataccctgacccagcggaccggtggtggtttccacaccagcggtataacctacttccgggtggcccggagttttagagtgcagctgacggaagtttttcagttcttccatcggcagatcgtaaccggtgaggtgcagcaggctgtagatcagcatggagccgtggccgttggacagcacgaagcggtcacggtcagcccaggacggattctgcgggttgtgtttcaggaaatcacgccacaggacttcggcaatgtcagccatacccataggggcacccgggtgaccggatttggctttctgtactgcgtccatgctcagcgcacgaatagcattggcaagctctttacgtgaggacattttgactccagatcggatgatgaagggcacgcccttaacgacttgacgacagcgcgttttgggctacgccggaaaatttgccaacaatttaccgcaagccgcgcgtcatgtacatggaacatccttttgctgcttcagaaatctctggatcatgctcgcatgttgcgcaatctactcgcccgtccgttgcgcttttccttatactgagactgagcgtcgattcacctgcaaacggcgcatttttagaataatcctgaccttgtgcggaagagaaaacatgaaaattcgcgccttattggtagcaatgagcgtggcaacggtactgaccggttgccagaatatggactccaacggactgctctcatcaggagcggaagcttttcaggcttacagtttgagtgatgagcaggtgaaaaccctgagcgatcaggcatgtcaggagatggacagcaaggcgacgattgcgccagccaatagcgaatacgctaaacgtctgacaactattgccaatgcgctaggcaacaatatcaacggtcagccggtaaattacaaagtgtatatggcgaaggatgtgaacgcctttgcaatggctaacggctgtatccgtgtctatagcgggctgatggatatgatgacggataacgaagtcgaagcggtgatcggtcacgaaatggggcacgtggcattaggccatgtgaaaaaaggaatgcaggtggcacttggtacaaatgccgtgcgagtagctgcggcctctgcgggcgggattgtcggcagtttatctcaatcacaactcggtgatctgggcgagaaattagtcaattcgcaattctcccagcgccaggaagcagaagccgatgattattcttacgatcttctgcgccaacgcggcatcagcccggcaggtcttgccaccagctttgaaaaactggcaaaactggaagaaggtcgccaaagctcaatgtttgacgaccatcctgcatccgccgaacgcgcccagcatattcgcgatcgtatgagcgcagatgggattaagtaaagcctggtggtgtcgaacgtaggtcagataaggcgttcacgccccttctgacatgaatggcacatttgttaccctgtgcgcattgccggatgcgatgctggcgcatcttatccggcctacgggtgccgaacgtaggtcggataaggcgttcacgccgcatccgacattaatggcacgttttacccgtgcgcatcgcatctggtgcttactcgccctttttcgccgcctgaatatagagcatctccagcgccagcgtcgccgcagccagagcggtgatttccgactgatcgtatgccggagccacttccactacgtccatcccaacgatgttgagatctttcaggccgcgtaccagtttaatggcgcgatcggaggtcaggccgccaatcactggcgtaccggttcccggcgcgaaagcaggatccaggcagtcgatatcaaaggtcaggtaaaccgacatatcacccacaatctgtttcacttgggcgataacgtcatccacgctgcgatcgttcacctggcaggcgtccagcacggtaaaaccgttgtctttatcaaactcggtacgaataccaatctgcacggaatgattcgggtcgatcagaccttctttcggcgcggtatagaacatggtgccgtggtcaaattcacaaccgttcgcgtaggtatcggtgtgggcgtcaaagtgtaccagcgccattttgccgaaatgcttcgcatgagcacgcagcagcggcagcgtaacaaagtggtcaccaccgaaggagagcatacgcttaccggcagccagcagcttctcggcgtgcgcctgcagcttctcgctcatctcacgggcatcgccaaaggcatataccagatcgccgcagtccacgacgttcagacgctcacgcatgtcgaaattccacgggaagcggttgtgttcccaggccagattcgtcgaaacctgacggatcgctgccggaccgtggcgaccacccgcacggccagaggtggccatgtcgaacggcacgccggtgatcacccagtcggcatcgctgtcatacggctggaagttcatcggcaggcgtaaaaaaccaaaggcgttggaaaccagtgagttatcgtattgatgacctaaggtgctcatggatggactcctattacaaagtcgatataaaaaaacccttccgcgtcgttaggcccgacgaggaagggttggatttgtcacaataaattgtggcggattatcaccgctaaattaagcggattcaagtaacacaggacttactcatcttcaagataagtataaccgtacaaacctgcctcgaactcttcaaggaactgttgttgcagttcagcatcaagatcggttttcttcacttgatcgcggaactgggttaacagcgttttcggatcgagctgtacatattgcagcatgtccgccacggtatcgccttcgtcagacagttctacttctacgctaccgtcagggaacacgaacacgtcaaccgcttcggtatcaccgaacaggttgtgcatattgccaaggatctcctgatatgcgccgaccataaagaaaccgagcatcggcggattctctggatcgtactccggcattggcattgtcgtggcaataccatcaccatcaatatagtggtcgatagcaccgtcagagtcacaggtaatatccagcagcacagcgcgacgttccggcacttgatccagcccttccagcggcagaaccgggaacaactggtcgatcccccatgcgtccggcattgactggaacagcgagaaattgacgtacattttgtccgccatacgttcctgcagttcgtcgattatcggacgatgcgcacggttttgcggatccagttgcttctgcacttcatggcacatgctcagatagagttgttctgcccatgcacgttcttgcaggctaaaggtgccggaagagtagccgatatgaatgtcgtgcagatccatctgactgtcgtgtaaccattcacgcagagaacggcgagttcccggttcgtgcatctcctgccaggtttcccacatgctttgcagcgcgcgcggcgcatcttctgcaggcgcggtcggcaccgtgtattcgttacgttccacgccgatgatattagacaccagcacggtgtgatgcgcagtcaccgcacgacccgattcggtgattaccgtcggatgcggcagaccgttttcttcacacgcatcaccaatcgcccagatgatgttgttggcatattcattgaggccgtagtttacggagcagtcagactgcgaacgggtgccttcatagtccacgcccagaccgccgccgacgtcgaagcactgaatattgacgcccagcttgtgcagttccacatagaaacgcgccgattcacgaacgcctgtggcgatatcgcgaatattcgccatctgcgaaccgaggtggaagtgcagtagttgcaggctgtcgagacgcccggcttcacgcagggtttcaaccagttgcagtacctgagtcgcagccaggccgaacttcgatttttccccgccggaggactgccatttacccgagccctgcgaagccagacgtgcacgcacgcccagacgaggaacgacattcagacgttctgcttcatccagcacaatggcgatttctgacatcttctcaatgaccaggtagaccttgtggcccatcttctcgccaattaatgccaggcggatatattcgcggtctttataaccgttgcagacgatgacgctacgggtcatgccagcatgtgccagcaccgccatcaactctgctttcgagcctgcttccagtcccagcggttcgcccgaatgaatcagggactcaatcacgcggcggtgctggttaactttgatcggataaacaaggaagtaatcgccgttatagccgtaggattcccgcgcacgtttgaacgcggcgttaatggaacgcaaacggtgctgcaggatctgtgggaaacagaacagtgcaggcagacgctgaccctgtgcttcacgagttttcactaactgcgcgagatcgacgcgagcttccgggacgtccgggtccgggcacacgctgatgtggcccagctcgttaacgtcatagtagttattgccccaccaggcaatattgtaagtacgcagcatcttgctggcttcctgggagctcattgcaacctcctgcatggagcgtagtacaccgtgttcgcccgctgacgaaggcaaacccatagacatgtcgtcagacatagcgaacctcaaattattttattaagtgtaaaacagttaacgactatcgcagcctggaactgcgataacaacccataagcacatggattttccagcagtgtatgctgacgctccgactgcgcaaccggtttctttttcataacattattaagcacataaccgaacgtaagtgtgacagttcggcgaaaccacgagaaaactcttgtttttacaagagcgcccttgttcagtcctcagtaactgtaaccagctcttgaatcctgagaagcgccgagatgggtataacatcggcaggtatgcaaagcagagatgcagagtgcggggaacgaatcttcaccagaacggtgagacaggttaagcagcagacaacggttcattatttcgtatcacctccacggccgcctgttaagacgaacccacaagccaaaactctgatttcaacccggctggaagtggcaacacgaaagaaacgtcgtgtgctttttatttaagccgcgcgccgcgttttataccccacaatggcagaaaattgcaaaagataaatacgcagaatgccggcattgtcaggaaaaatttccagccacgtttttaacagaatgagacacgattcaaaaaaaagtggaaatcgggtgaagaattgacctaaaatagccatccagatgttaatccatccataccgattaacactcagactgccagtgtttttaacctgcagagtcgtggtaggatccgctaccacagaaaatccacacaacagtttgagctaaccaaattctctttaggtgatattaaatatggcaaaacacctttttacgtccgagtccgtctctgaagggcatcctgacaaaattgctgaccaaatctctgatgccgttttagacgcgatcctcgaacaggatccgaaagcacgcgttgcttgcgaaacctacgtaaaaaccggcatggttttagttggcggcgaaatcaccactagcgcctgggtagacatcgaagagatcacccgtaacaccgttcgcgaaattggctatgtacattccgacatgggctttgacgctaactcctgtgcggttctgagtgctatcggcaaacagtctcctgacatcaaccagggcgttgaccgtgccgatccgctggaacagggcgcgggtgaccagggtctgatgtttggctacgcaactaatgaaaccgacgtgctgatgccagcacctatcacctatgcacaccgtctggtacagcgtcaggctgaagtgcgtaaaaacggtactctgccgtggctgcgcccggacgcgaaaagccaggtgactttccagtatgacgacggcaaaatcgttggtattgatgctgtcgtgctttccactcagcactctgaagagatcgaccagaaatcgctgcaagaagcggtaatggaagagatcatcaagccgattctgcccgctgaatggctgacttctgccaccaaattcttcatcaacccgaccggtcgttttgttatcggtggcccgatgggtgactgcggtctgactggtcgtaaaattatcgttgatacctacggcggcatggcacgtcacggtggcggagcattctctggtaaagatccatcaaaagtggaccgttccgcagcctacgcagcacgttatgtcgcgaaaaacatcgttgctgctggcctggccgatcgttgtgaaattcaggtttcctacgcaatcggcgtggctgaaccgacctccatcatggtagaaactttcggtactgagaaagtgccttctgaacaactgactctgctggtacgtgagttcttcgacctgcgcccatacggtctgattcagatgctggatctgctgcacccgatctacaaagaaaccgcagcatacggtcactttggtcgtgaacatttcccgtgggaaaaaaccgacaaagcgcagctgctgcgcgatgctgccggtctgaagtaatctttcttcacctgctttcaaaggccagcctcgcgctggcctttttcttttacctcaccgcggtggataggcattcacgccgcatccggcaaaaagctgcccgcacaataacatcattcttcctcaacacgttttatcgcaaattatcatcactactgaaaccgattacaccaataacaccagccaaatatttgtaatattttcatattattattcagttttcacagttgttacatttcttttcagtaaagtcttaattgcagataacagcgtttaatctatgatgatataactcaattattttcatgcacttaaaccataactaagataaatgttagtgtaagcgattacactgatgtgatttgcttcacatctttttacgtcgtactcacctatcttaattcacaataaaaaataaccatattggagggcatcatgcctgacgctaaaaaacaggggcggtcaaacaaggcaatgacgtttttcgtctgcttccttgccgctctggcgggattactctttggcctggatatcggtgtaattgctggcgcactgccgtttattgcagatgaattccagattacttcgcacacgcaagaatgggtcgtaagctccatgatgttcggtgcggcagtcggtgcggtgggcagcggctggctctcctttaaactcgggcgcaaaaagagcctgatgatcggcgcaattttgtttgttgccggttcgctgttctctgcggctgcgccaaacgttgaagtactgattctttcccgcgttctactggggctggcggtgggtgtggcctcttataccgcaccgctgtacctctctgaaattgcgccggaaaaaattcgtggcagtatgatctcgatgtatcagttgatgatcactatcgggatcctcggtgcttatctttctgatacagccttcagctacaccggtgcatggcgctggatgctgggtgtgattatcatcccggcaattttgctgctgattggtgtcttcttcctgccagacagcccacgttggtttgccgccaaacgccgttttgttgatgccgaacgcgtgctgctacgcctgcgtgacaccagcgcggaagcgaaacgcgaactggatgaaatccgtgaaagtttgcaggttaaacagagtggctgggcgctgtttaaagagaacagcaacttccgccgcgcggtgttccttggcgtactgttgcaggtaatgcagcaattcaccgggatgaacgtcatcatgtattacgcgccgaaaatcttcgaactggcgggttataccaacactaccgagcaaatgtgggggaccgtgattgtcggcctgaccaacgtacttgccacctttatcgcaatcggccttgttgaccgctggggacgtaaaccaacgctaacgctgggcttcctggtgatggctgctggcatgggcgtactcggtacaatgatgcatatcggtattcactctccgtcggcgcagtatttcgccatcgccatgctgctgatgtttattgtcggttttgccatgagtgccggtccgctgatttgggtactgtgctccgaaattcagccgctgaaaggccgcgattttggcatcacctgctccactgccaccaactggattgccaacatgatcgttggcgcaacgttcctgaccatgctcaacacgctgggtaacgccaacaccttctgggtgtatgcggctctgaacgtactgtttatcctgctgacattgtggctggtaccggaaaccaaacacgtttcgctggaacatattgaacgtaatctgatgaaaggtcgtaaactgcgcgaaataggcgctcacgattaatctccccaagcttcctcccatcgcggaggaagccacctcttgcagtcatcttttcttcgctctatcctctgccgctatgaaaacatcccgtctccctatcgccatccaacaggccgttatgcgtcgcctgcgggaaaaactcgcccaggccaacctgaagctagggcgtaactacccggagccaaaactctcttacacccagcgcggaacctccgccggaacagcctggctggaaagctatgaaattcgcctcaatcccgttttgctgttggaaaacagtgaagcctttattgaagaagtggtgccgcacgaactggcacatttgctggtatggaaacatttcggccgcgtagcgccacatggcaaagagtggaagtggatgatggaaaacgtgctgggtgttcccgcccgtcgtacgcatcagttcgaactgcaatccgtgcgtcgcaacaccttcccctaccgctgcaagtgccaggagcatcagcttaccgtacgccgccataatcgcgtagttcgtggcgaggccgtctatcgctgtgttcactgcggtgaacagctggttgcgaaataaccatctgaactatcaggaactttcctgatctggctgattgcataccaaaacaactttcgctacgttgctggctcgttttaacacggagtaagtgatgtaccgttatttgtctattgctgcggtggtactgagcgcagcattttccggcccggcgttggccgaaggtatcaatagtttttctcaggcgaaagccgcggcggtaaaagtccacgctgacgcgcccggtacgttttattgcggatgtaaaattaactggcagggcaaaaaaggcgttgttgatctgcaatcgtgcggctatcaggtgcgcaaaaatgaaaaccgcgccagccgcgtagagtgggaacatgtcgttcccgcctggcagttcggtcaccagcgccagtgctggcaggacggtggacgtaaaaactgcgctaaagatccggtctatcgcaagatggaaagcgatatgcataacctgcagccgtcagtcggtgaggtgaatggcgatcgcggcaactttatgtacagccagtggaatggcggtgaaggccagtacggtcaatgcgccatgaaggtcgatttcaaagaaaaagctgccgaaccaccagcgcgtgcacgcggtgccattgcgcgcacctacttctatatgcgcgaccaatacaacctgacactctctcgccagcaaacgcagctgttcaacgcatggaacaagatgtatccggttaccgactgggagtgcgagcgcgatgaacgcatcgcgaaggtgcagggcaatcataacccgtatgtgcaacgcgcttgccaggcgcgaaagagctaacctacactagcgggattctttttgttaacccctaccccacgcgtacaaccgcgtggggagacgacgcggatttttaactatgcgtatcccccgcatttatcatcctgaaccactgaccagccattctcacatcgcgctttgcgaagatgccgccaaccatatcgggcgcgtactgcgcatggggccggggcaggcgttgcaattgtttgacggtagcaaccaggtctttgacgccgaaattaccagcgccagcaaaaaaagcgtggaagtgaaggtgctggaaggccagatcgacgatcgcgaatctccgctgcatattcacctcggtcaggtgatgtcgcgtggtgaaaaaatggaatttactatccagaaatcgatcgaactcggtgtaagcctcattacgccacttttttctgagcgctgcggcgttaaactggatagtgaacgtctgaacaagaagcttcagcagtggcagaagattgcaattgctgcctgtgagcagtgtggtcgtaaccgggtgccggaaatccgtccagcgatggatctggaagcctggtgtgcagagcaggatgaaggactgaaactgaatcttcacccgcgcgccagtaacagcatcaatacgttgccgttaccggttgaacgcgtccgcctgctgattggcccggaaggcggtttatcggcagatgaaattgccatgactgcccgctatcaatttactgatatcctgttgggacctcgcgttttgcgtacagagacaactgcgctcaccgccattaccgcgctacaagtacgatttggcgatttgggctaacggagaagaataatgatcaagctcggcatcgtgatggaccccatcgcaaacatcaacatcaagaaagattccagttttgctatgttgctggaagcacagcgtcgtggttacgaacttcactatatggagatgggcgatctgtatctgatcaatggtgaagcccgcgcccatacccgcacgctgaacgtgaagcagaactacgaagagtggttttcgttcgtcggtgaacaggatctgccgctggccgatctcgatgtgatcctgatgcgtaaagacccgccgtttgataccgagtttatctacgcgacctatattctggaacgtgccgaagagaaagggacgctgatcgttaacaagccgcagagcctgcgcgactgtaacgagaaactgtttaccgcctggttctctgacttaacgccagaaacgctggttacgcgcaataaagcgcagctaaaagcgttctgggagaaacacagcgacatcattcttaagccgctggacggtatgggcggcgcgtcgattttccgcgtgaaagaaggcgatccaaacctcggcgtgattgccgaaaccctgactgagcatggcactcgctactgcatggcgcaaaattacctgccagccattaaagatggcgacaaacgcgtgctggtggtggatggcgagccggtaccgtactgcctggcgcgtattccgcaggggggcgaaacccgtggcaatctggctgccggtggtcgcggtgaacctcgtccgctgacggaaagtgactggaaaatcgcccgtcagatcgggccgacgctgaaagaaaaagggctgatttttgttggtctggatatcatcggcgaccgtctgactgaaattaacgtcaccagcccaacctgtattcgtgagattgaagcagagtttccggtgtcgatcaccggaatgttaatggatgccatcgaagcacgtttacagcagcagtaacccaccttagcgagaaggatctcgttgagactctgagtgacagcgcccttctttccacgcatactgggcgctgttgcttttttgaaccaggaaacagaacctctgacaatgaatttacagcatcactttcttattgccatgcctgctctccaggatccgattttccgtcgttccgtggtctacatttgcgaacataataccaatggtgcaatggggatcatcgtcaacaagccgctggaaaatctcaaaattgaagggattctggaaaagctgaagatcacgccggagccgcgtgatgaatcaatccgtctggataaaccggttatgctcggcggtccgctggctgaagatcgcgggtttattttgcatactccgccctccaattttgcttccagcattcgcatttcagacaacacggtaatgaccacttcccgcgatgtgctggaaacgctcggcaccgataaacaaccgtctgacgtattggtggctctgggttatgcctcctgggagaaaggtcaactggaacaagaaattctcgataacgcgtggctaacggccccggcagatctgaatattctgttcaaaacgccgattgccgaccgctggcgcgaggcggcaaaactgattggtgtggatattctcaccatgcctggtgtggcaggacacgcctgatgagtggaaccttactcgccttcgacttcggcaccaaaagcattggcgtagcggtcggccaacgcattaccggcaccgctcgccctttgcctgcaattaaagcacaggacggtacgccggactggaacattatcgagcgtttactgaaagagtggcagccggacgaaatcatcgtcggtttgccgctgaatatggacggcaccgagcaaccattgactgccagagcgcgtaaattcgccaaccgtattcatggtcgtttcggtgttgaagtaaagctccatgacgagcgtcttagcaccgtggaagcccgttccggtctgtttgaacagggcggctatcgggcgctcaacaaaggcaaagttgactctgcctctgcggttattattctcgaaagctatttcgagcagggatattaaggcgatttaaaagcctggcggatagtcgttaccgtcatccggccattttgccggatgctgcgtgaacaccttatccagcacacatctggcagcggctgtaggtctgataagacgcgttagcgtcgcatcagacatttattgcctttgtagatactgttatggcctgcaagttttttcctggtccggtttcccggattgcaggcatgccagacacagcgccgtcaggcgctgtttttttcatcccttccgcgatttttacgccgctaccggattatgccgtgacgcatcgaacggcacgcctgacttcagcactccatacgccacctgtgccagcttgcgcatcatcgcgccgagaatcacctttcctttcttgccattagccgccagacggtcgcggaacgcccgtccccactcagtcttactggtggctaccattgcgggcatatacaacgccctgcgaagcgacacatgtccggccttactcatccggctcgcccctctcacactgctacctgattcataacgccgtggtgtcagacccgcaaaagcggcgaactgtctggcatgggcgaagcggtccttcagaccgatataagccagcaataccgcagatgttttctctccgatacccgggatgctttccagcagtttcctgcggtgtttcatatccggatcatcgtctgtcaggtcttttatctgcttctcaagacgcttcagctctgcttcaagccacagaaggtgagcatcaatgctcggtctctggacttcccgcgccgtttcagtgcgattcagttcctgcgtgtgcatatctgtcagcgcctggtggcggactaccagggcacgcaacgcgcgttcaagcgggtgaggcgcttcccaggctgcagggcgcttctgacgacagaactctgccagcatgcgcgcatccacggtatcagtcttgttacgcagtccttcactctgagcgaaagctttacccagcgcaggattaatgactgacactatgtagccagcatcgtaaaggcactcagcgacaggttccatataggtgccggtcgcttcgatgcagatatgcgcatggtcaatcttgtgacctttcagccagctcaccagctcatcgtgccctttagtggtgttagcgaattttttggtgcgatgacgaccatcaggacgcaacacatcgacatccagtttctctttagcggtgtcgataccgatataatgaagttcatgttccatagtgaaaccaaccttgcaaatacggattaccgggaaaaccggtccatgatactgtccggtttatcactttgggagaaaggcagtccgctgcataaatctacgcaacaggttagaacccaaggcccgatacggcatgcggactgcaggcagagaaaactggccgattttctctgcactggagggataatacaaggcccgataagcttgcgcatcgggcatggcaacgtcacaaacgcccttcccccacccggtgctgataactctgctgaaacgttatcatccccacctgctgcccggtttgaataacatgcggtaactggtgggttttcccttcacgaatcaaattccccaccgcgggtgtgttaatcagcaattcaaatagcgccacgcgtccttcctgtttatccacttccagcttttgtgacagcactgcccgtaaactacctgccagttgattacgcacggggtctttttcctgcgccggaaatgaatccaccagtcgctcaactgcctgcgcggcaccacgtgtatgtaaggttgccagcaccagatgcccggtttctgccgccgtcagcgccagacggattgtctcactgtcacgtagctctccgagcaaaatcacatcaggatcttcccgcaatgcggcccgcaaccccgatgcgaacgtcatacagtgcaaaccaatttcccgctgctggatcaaacatcgctggctggcatagagatattccacaggatcttccagcgtcagaatatgcgcatcggcatgttgattaagatagccaaccatcgccgccagcgtggtagatttgccactccccgtcgcccccgtcaccagaatcatgccattctcgctcttgagtaattccggcaataccggtggcgcaccaagctgttcgagctgtggacagtgcgaaggtaacaaccgtaatgccagagaaataccttgccgttgcgcgaacgcactgccacgcaaccgctggttttccgccagcgacacggcaaaatccagctggccattttccagcaatattgcccgctgatcgtcatccagccactcccgcagtagctcttcgacgtccggcgcatcaaacggcgcagcttccattagcccgcgaatgcgccatcgtgcgggccaggcgctgcacaggtgtagatccgagacgttatgctttacactaagggccacaatttcttccatattcatactaagatcctcggaaaatgaacgatattgcgcataacctggcacaggtccgggacaaaatctcagcggctgcaacgcgttgcggccgttctccagaagaaattacgctgcttgcagtcagtaaaacaaaacctgcgagcgccatcgcagaagccattgatgccgggcagcgtcaatttggtgaaaactacgttcaggaaggggtagataaaattcgccactttcaggaactgggcgtaacaggattagaatggcattttattggcccgttgcagtctaataaaagccgcctggtggcagagcatttcgactggtgtcataccatcgaccgtttgcgcattgctacccgcctcaacgatcagcgcccggcagaacttccccctcttaacgtactgattcaaattaatattagtgatgaaaacagtaagtccgggattcaactggcagaactggacgagctggcagcggcggtcgctgaactaccgcgtttacgtctgcgcgggctgatggcaatccctgcgcctgagtcagaatatgtaaggcagtttgaagttgcacgccaaatggctgtagcatttgccggactgaaaacgcgctacccgcatatcgacacgctctctctgggaatgtcggacgatatggaagccgccattgcggcaggtagcacgatggttcgtatcggcactgcaatttttggtgcgcgtgattactctaaaaaataaggaattaaaggaacgccatgaatacgttgactttcctgctttcaacggtcattgagctgtataccatggtgctgttattacgcatctggatgcagtgggctcattgtgatttttacaaccccttctcacagtttgtagtgaaggtaacgcagccaattatcgggccactgcgccgcgttattccggcaatgggtcccattgacagcgcctcgctgctggttgcctatattctcagttttatcaaagccattgtgctgtttaaagtggtgaccttcctgccaatcatctggattgccggtttactgattctgctgaaaaccatcggcttgctgattttctgggtcctgctggtgatggcgattatgagctgggtaagccagggtcgtagtccgattgaatacgtgctgattcagctggccgatccgctgctgcgcccgattcgccgcctgctaccggcaatgggtgggattgatttctcgccgatgatcctcgttctgctgctgtatgtcatcaatatgggtgtcgcagaagtattacaggcaaccggaaacatgctgctgccggggctgtggatggcgttatgagtgccgtaacagttaatgatgacggtctggttttacggctctatattcagccgaaagccagccgtgattctattgtcggtttacatggcgacgaagttaaagtcgccattaccgcgccgccggttgacggccaggccaacagccatctggtgaagtttctcggtaagcaattccgggtagccaaaagccaggtggtaattgaaaaaggcgaacttggccgccacaaacaaattaaaatcattaatccgcaacaaatcccgccagaaatcgcggcgttaattaattaggtatcctatgcaaaaagttgtcctcgcaaccggcaatgccggtaaagtgcgtgagctggcgtcgctgcttagcgacttcggtcttgatatcgtggcccaaacagacctcggcgtagattccgctgaagaaaccggcctgacctttatcgaaaacgcgattctgaaagcgcgccatgcggcaaaagtgaccggtttaccggcaattgccgacgactctggtctggcggtagatgcgctgggtggcgcgccgggtatttactccgcgcgttattccggtgaagacgcgaccgatcaaaagaatctgcaaaaactgttggaaacactgaaagacgtaccggacgaccaacgtcaggcgcgtttccactgcgtgctggtatatctgcgtcacgcggaagatccgactccgctggtgtgccacggtagctggccgggcgtgattactcgtgaaccagcgggcactggtggctttggttatgatccaatcttcttcgtaccttccgaagggaaaaccgctgccgaactgacccgcgaagaaaagagcgccatttcccaccgtggtcaggcattgaaactgctgttggacgctttacgtaatggttaaattaccgccgctgagtctctacattcacatcccgtggtgcgtgcagaaatgcccgtactgcgatttcaactctcacgcgttgaaaggagaagtgccgcacgacgattacgttcagcatctgctttgcgatctggacaatgatgtggcttacgctcagggccgtgaagtaaagacaatctttattggcggtggtacgccgagcctgctttccggcccggcgatgcaaacgctgctggacggcgtgcgtgcgcgtttgccgctggcagcggatgcagaaattactatggaagcgaaccctggtacggtagaagccgatcgctttgtcgattatcagcgtgctggtgtgaaccgcatctctattggtgtgcagagttttagcgaagaaaagctgaaacgacttgggcgcattcatggcccgcaagaagcgaaacgagcggcaaagctggcgagcggtttagggttacgtagctttaaccttgatttgatgcatggactaccggatcaatcactggaagaggcgcttggcgatctacgccaggccattgaactgaatccgccgcatctttcctggtatcaactgaccatcgaacccaatacgctgtttggttcgcgaccaccggtgctgccggacgacgacgcgctgtgggatatattcgaacaggggcatcagttattaaccgcagcgggttatcagcaatatgaaacttccgcttacgccaaacccagttatcagtgccagcacaatctcaactactggcgctttggcgactacatcggtattggctgcggcgcgcacggcaaagtgaccttcccggatgggcgcattcttcgtaccactaaaacgcgtcatccgcgtggttttatgcaaggaaggtatctggaaagccagcgtgatgtcgaagccgcagataagccgtttgagttctttatgaaccgctttcgcttgctggaggccgcgccacgcgcagagtttagtgcgtataccgggctttgcgaagatgtgattcgcccacagttagacgaggcgattgcccagggttatctcaccgaatgtgcggattactggcagataacggaacatgggaagctgtttttaaattcgctgctggagctttttctggctgagtaaacttgtattgccggatgcggcgtgaacgccttatccagccgacatgtggcagcggttgtaggtctgataagacgcgcaagcgtcgcatcagacgttgattgccggatgcggggtcaacgccgcatcctgctacaaatcgtgcactatatcaaacttacttaatcaccccattgcgccacagttgttcggtatcttttttccagcgttcattagcttggttgatatcgtcaattttcatcaaaatcgcgacttttttactgtttatttctgaaactttcatcgttaacggatattgccctttttcgagcgttacccagtcatcctgcaatttacggctgagtttttgtgattgcagaaaagtctgtcgccgttgttcgttgatatcgaaatctcgtttctgctgaatcggcacttcataacactcttcactctgtttatgacatgccgcaatcgccggttgataaacctctttgtcatatttaaccgcgaacgcctcgctatcgttctgtttattaaactcatcacgctgttggtgaatttttttaaaggcttcttcgcgggtcatttgcttaccgtttgcatcttttccccaatatgcatccgctgctttctgcgccgccaccatttgcttatcaagcgctttcacttccttttccagcgcaggaatcgagttcttctgggtattcaacgcagattcaagctgactaaagcgataattgaaatcttcgctattcacgatcagatatttattattcgttttgatatcgtcgaccacccgcccacgatcgctggctgccgcctgaaaagagtaaaagttcaccgaccagccagacgcgggcgttcctttactggttaacatcgccgagaattttaccggtttatctttcgtccaggtctgttcgagcagttcgtaatctgccaactgaccgacccaggtatagagatcgtcactggaagagacatcgccttccgctgaccaggtggcctgattacccttagcatcaagattttttaaggtgatagcatcaagcttgagaatgccgtgatactgctttttgaattgatcttttaagatattttcagttggcggttcgccatctgcccaggcattaccagtcatcaacataagcagtgccgtgccaacaatccattgctttttcacccgaaaaacctcacgcggaataatttattccggtgattatcattagggtaatgaaaattggcaatggacgtaagtctgaagtgaaaaagccccggcacgataccggggcgaggtgattagtactgattgaagatctgctggatctgctgcggatctttggtttgcgtcagagccagctgcagcaggacgcgcgctttttgcgggttcagcgtgccagaggcgacgaagccgtatttcgcatcatccacttcagcatcctgagtggtagcacccgtcggtacgcgggaagaacgcactactgcagtgccgtttttcgcggcggttgccagggtgtcgaacacggatttatacaggttaccattacccacaccagcgctaacgatgccatcatagcccgcatctaccagtgctttagccggaagatcggatgcgttagcgtagttataaacgatgccgactttcggcagctcattcagcttagagacatcgaatggcgtatcgctggtgtgcttacgtgccggggtacgttggtagtcaatcttaccgttgtgaatgtatcccagaggaccgtagttaacagacttgaaggtcgctacgtcggtggtgttggttttggtgacatcgcgaccgtccagtacggtgtcgttcatcaccaccagcacgccacgattagcggaggctttatcagctgcggtcactaccgcgttatacaggttgaatggaccgtctgcgctcatggacgtggacgggcgcattgcgccgaccatcaccaccggtttgtcgcatttcaccgtcaggtcgaggaagtaagcggtttcttccatcgtgtcggtaccgtgggtaatgacgaagccgtcggttttatcgcagtcggtgttaatttttttcgccagtgtcagccagacattatcgttcatgtcctgggagccgatattcactacctgctcgcctttaacgttcgcaatgtcttttagttgcggcaccgcattaaccagattttctacgccaactttacccgctgtgtagttagatttggttgcggagtcaccaccaccggcaatggtcccgccggttgctaaaatggtgatattgggtaatgccaatgctgcaccactaaaacccataaccagtgcggcaagtgccgtctttttgaaaaactccatttcattcctccagttacgtgaacgctacgcattatcccttagctctgtatgggaaatttgacgttaaacaatttacaacgtgaatatattttggagatctacaaagttagaggcaggtaacaaaacgaagaattaaacggcataaaaaagtattatgccgtcttaaaatagaggattattttaaattcccgaccagggctttgcggctatcttccagagtcacaacgcggctacaaacatctttgccaaactgctggaaatctttttcctgctttttccactcggtttggattgaggattgcagcccccccaggcttcccagcacattctgtaatgggttaccgccgcttttcagcaccgctttcgcgcccatttcattaatgctgtcctgtaaaattccacccattgcctgattcactaattgctggccttcggcgcgaacctgatcaatggctttatagtgaaacgtcaggccatcgctgcgcgtttcgataatgcggttcatctgctctttcagctgcgcatcaagtttggtcagacggctgcgcattttgctgctttcgcccatctcctgaacgataattttatccagcgcaatacgggctttttcgacgcggcttttcgcgccttcatcaatccacggcagcgtgctgcgtagttcagcctgataatccttcgcctgctcgcgctgggcggcattcagggaatattgcttaccgttatacatcacgttgccgtctggcgtgatcaccagattgccgttttcgcccttcacctgcacggtttgcgggctgacaatcacatcgtcacgcggcgtgacgctgcactggtagtcggcgtgagcggtcattgccgtcactgaaagtgctgccgccagcagcattttgcgcatcatagtcttccctcaagaaaaaatcaggccagcatttgctggccccagattgataacaaagtacgcgttttccatgccggatgcggcgtaaacaccttatcccgcctactcgatcgtgcatctttccaggcctgataagcgtagcgcatcaggcagttttgcatttgtcatcgcccgtatgctttcttagtcccaccaaacgtcgaaaagttcgctggtgcgtacctcatccagtttgcgctcttccagccacttacgcacaatcgcctgatgttcttcggtgcatttgccgatttcctgcatgcagatcagaccttcccaggccagataaccgctgccgtcaaaggccagtttgttcggttcgataacctcgttaataaaatcatcaacggttttatcaatctgttcttccgatgtaccttccgggaatcgccatgccaccgaaaatcctaattcctggaattcgtcgatgtgcatttttttacgcagacgacggctacggttctttgccattatttcaccctctcgaacattaagtcccatactccgtgaccaagacgatgaccacgttgttcaaatttcgtcaccggacgtgatgccggacgcggtacgtaatcattgctctctgacaggtttttataaccgtcaatagaagacatcacttcaagcatatgttccgcataaggttcccagtcggtcgccatatggaataccccccccagctgcagtttgctttttaccagttcggcaaacggcacctgtacgatacggcgtttattatggcgcgctttgtgccacgggtcagggaaaaagagctgcaccatgcgcaatgaattgtcaggaatcattttatgcagcacttcaaccgcatcgtgacacatcactcgcaggttgcttaaaccttcttcatgcgcagaagccaggcacgcaccaacgcccggtgaatgcacttcaatgccgaggaagtcctgctcagggcgatctttagccattgccaccagcgacgcccccatgccaaaaccaatctcaagcgtcaccggcgcttcacggccaaaaagcgcggggaaatccagcatatcttcgctgaactcaacgcccatcaccggccagtagttttccagcgcatgttcctggcctttggtcagtcgcccctggcggcgcacaaaactacggatacggcgcagtgggcggccgttttcatcaaattccggtgaaatgacgtcgtttttcataaagatttagtcgcttgtgaaagtgttctgaaaacgggcattatccaaagttagttgccggatgcaagcatgataaggccgtggctgcggaaagttccggtttacaccctgccgtcgctgtgctgcaatcttgcccccaacaacagtgaattcggtgaccatgcaagcgtcgcaattttcagcccaggttctggactggtacgataaatacgggcgaaaaacgctgccctggcaaattgacaagacgccctacaaagtatggctctcagaagtgatgttgcaacaaactcaggttgcgaccgttatcccctattttgaacgctttatggcgcgcttcccgacggtgaccgatctcgccaatgcgccgctcgacgaagttctccacttgtggaccgggcttggctattacgcccgcgcgcgcaatctgcataaagcggcacaacaagtggcgaccttacacggcggtaaattcccggaaacctttgaagaagtcgcggcgttaccgggcgtcgggcgttccaccgcaggcgcgattctctcgctttctctgggtaagcactttccgattctcgacggtaacgtcaaacgcgtgctggcgcgctgctatgctgtaagcggctggcctgggaaaaaagaggtcgagaataaattatggagtttgagcgagcaggtgacgcccgcggttggcgtggaacggtttaatcaggcgatgatggatttgggtgcgatgatttgtacgcgctcgaaaccgaaatgttcgctctgtccgctacaaaacggatgtattgccgccgccaacaatagctgggcgctttatccgggcaaaaaaccgaaacagacgctgccggagcgcaccggctactttttgctattacagcacgaagatgaagtattgctggcgcagcgtccgccgagcggattgtggggcggtttatactgtttcccgcagtttgccgacgaagaaagtttgcggcagtggctggcgcaacggcagattgctgccgataacctgacgcaactgaccgcgtttcggcataccttcagccatttccacttagatattgtgcctatgtggcttcccgtgtcgtcattcaccggctgcatggatgaaggcaatgcgctctggtataacttagcgcaaccgccgtcagttggcctggcggctcccgtggagcgtttgttacagcagttacgcactggcgcgccggtttagcgcgtgagtcgataaagaggatgatttatgagcagaacgattttttgtactttcctgcaacgtgaagcagaaggtcaggattttcagctgtaccccggcgagctgggaaaacgcatctataacgagatctccaaagaagcctgggcgcagtggcagcacaagcaaaccatgctgattaatgaaaagaaactcaacatgatgaatgccgagcaccgcaagctgcttgagcaggagatggtcaacttcctgttcgagggtaaagaggtgcatatcgagggctatacgccggaagataaaaaataaaaacagtgccggagcacgcctccggcaacttgcataaaaacaaacacaacacgcacccggaatgatgaaaaaatatctcgcgctggctttgattgcgccgttgctcatctcctgttcgacgaccaaaaaaggcgatacctataacgaagcctgggtcaaagataccaacggttttgatattctgatggggcaatttgcccacaatattgagaacatctggggattcaaagaggtggtgatcgccggtcctaaggactacgtgaaatacaccgatcaatatcagacccgcagccacatcaacttcgatgacggtacgattactatcgaaactatcgccgggacagaacctgccgcgcatttgcgccgggcaattatcaaaacgttgctgatgggtgacgatccgagttcggtcgatctctattccgacgttgatgatattacgatttcgaaagaacctttcctttacggtcaggtggtggacaacaccgggcagccgattcgctgggaaggtcgcgcaagcaacttcgcggattatctgctgaaaaaccgtctgcaaagccgcagtaacgggctgcgtatcatctacagcgtcaccattaacatggtaccgaaccaccttgataaacgtgcgcacaaatatctcggcatggtccgccaggcgtcacggaaatatggcgttgatgagtcgctgattctggcaattatgcagaccgaatcttcctttaacccgtatgcggtcagccgttccgatgcgctgggattaatgcaggtggtacaacatactgccgggaaagatgtgttccgctcgcaggggaaatccggcacgccgagccgcagtttcttgtttgatcctgccagcaatattgataccggcaccgcgtatctggcgatgctgaacaatgtttatctcggcggaattgataacccaacatcgcggcgttatgccgtcatcaccgcctataacggcggcgcaggcagcgtgctgcgagtcttttcgaatgataagattcaggctgccaatattattaacaccatgacgccgggcgatgtttatcagacgctgacgacccgccatccctctgcggaatctcgccgttatctttataaagtgaataccgcgcaaaaatcctaccgccgccgataattccattaaccgcccctgacgatgctcaggggcaaaaatgttatccacatcacaatttcgttttgcaaattgggaatgtttgcaattatttgccacaggtaacaaaaaaccagtccgcgaagttgatagaatcccatcatctcgcacggtcaaatgtgctttttcaaacactcatccgcatcacgatgtgaggaaattaacatgaatcttaagctgcagctgaaaatcctctcttttctgcagttctgtctgtggggaagttggctgacgaccctcggctcctatatgtttgttaccctgaagtttgacggtgcttctattggcgcagtttatagctcactgggtatcgcagcggtctttatgcctgcgctgctggggattgtggccgacaaatggttaagtgcgaaatgggtatatgccatttgccacaccattggcgctatcacgctgttcatggcggcacaggtcacgacaccggaagcgatgttccttgtgatattgattaactcgtttgcttatatgccaacgcttgggttaatcaacaccatctcttactatcgcctgcaaaatgccgggatggatatcgttactgacttcccgccaatccgtatctggggcaccatcggctttatcatggcaatgtgggtggtgagcctgtctggcttcgaattaagccacatgcagctgtatattggcgcagcactttccgccattctggttctgtttaccctgactctgccgcatattccggttgctaaacagcaagcgaatcagagctggacaaccctgctgggcctcgatgcattcgcgctgtttaaaaacaagcgtatggcaatcttctttatcttctcaatgctgctgggcgcggaactgcagattaccaacatgttcggtaataccttcctgcacagcttcgacaaagatccgatgtttgccagcagctttattgtgcagcatgcgtcaatcatcatgtcgatttcgcagatctctgaaaccctgttcattctgaccatcccgttcttcttaagccgctacggtattaagaacgtaatgatgatcagtattgtggcgtggatcctgcgttttgcgctgtttgcttacggcgacccgactccgttcggtactgtactgctggtactgtcgatgatcgtttacggttgcgcattcgacttcttcaacatctctggttcggtgtttgtcgaaaaagaagttagcccggcaattcgcgccagtgcacaagggatgttcctgatgatgactaacggcttcggctgtatcctcggcggcatcgtgagcggtaaagttgttgagatgtacacccaaaacggcattaccgactggcagaccgtatggttgattttcgctggttactccgtggttctggccttcgcgttcatggcgatgttcaaatataaacacgttcgtgtcccgacaggcacacagacggttagccactaattacgcaaagaaaaacgggtcgccagaaggtgacccgttttttttattcttacttcaacacataaccgtacaaccgtttcacgccatccgcatcggtttcgctataaacaccttgcagctccggcgaaaatcccggcaacaaattcaccccttcttccagtgcaaggaaataacgttgaaccgccccaccccagacttccccgggtaccacgcaaagcacgccaggtggataaggcaacgccccttctgccgcaattcgcccttcggcatcacgaatccgcaccaactccacgtcaccgcgaatataagcgctatgcgcatcctgggggttcatcaccactgacgggaaactctgctggcggaacatcgctttttgtaggtctttgacgtcgaaactgacatacagatcgtgcatctcctgacacaactggcgcagggtgtagtcgcgatagcgcaccggatacttgttataaacgctcggcaacacctcaaccagcggcgagtcatcctcaatatgctgttcaaattgcgccagcatcgccaccagttgtgccagcttctcgtggctttccgccggagttaataaaaacagaatggagttgagatcgcacttctccggcacaatgccgttctcacgcagatagtgcgccagaatcgtcgccggaacgccaaagtcgctatattcgccggtttcggcatcgatacctggtgtagtgagtaacagcttgcacggatcaacaaaatactgatccgcggcatatccttcaaagccgtgccacttcgcccccggctcaaaactgaaaaaacggcggtcgctggctaacacagatgtcggataatcctgccacaatttgccatcaacaacgggcgggataaacgggcggaacagcttacagcgcgcaagaatagccttgcgcgactcaatacccaactcaacgcactcagcccacagccgacgcccactctccccttcatgaattttggcgttaacgtccagggcggcaaacagcgggtagaacgggctggtagaagcatggagcataaaggcattattcaaccgcttatgcgggcaaaaacgcgcctgtccgcggatatggttatcttttttatggatctgcgacgtctgtgagaatcccgcctgctgtttgtgcaccgactgagtcacaaagatccccggatcgttttcgttaagttctaatagcagcggcgagctatccgccatcatcgggataaattgttcgtaaccgacccacgcggaatcaaacagaatgtaatcacacagatgcccaacggtatcgatcacctgacgggcgttatagacagtgccgtcataggttcccagctgaataatcgccaggcgaaacgggcgcggcaggtcggctttttctggcgcaacgtcgcgaatttgctggcgcagatactcttcattaaaacagtgcgcatcaataccgccaatgaaaccaaacgggttgcgtgaagcttccagatagaccggcgtcgcccccgcctgaatcagcgcgccgtgatgattcgacttatggttgttacggtcgaagagcaccagatcgccacgcgttaacagcgcattcgtcaccactttattcgctgccgatgtgccgttcagcacaaaataggttttatcggcatgaaagactttggctgcgaatttctgcgcatctttcgccgatccttcatgaataagcagatcgcccagtttcacatcggcattacacatatcggcgcgaaagacgttctcaccgaagaaatcgtaaaaatggcgtccggcaggatgctttttaaagaacgcaccatgttgatgtccagggcaagcaaaggtgctgttgcccatctcaacgtactgcgtcagcgtgtcataaaacggtggcagcaaattctcttcatactgacaggctgcggattccagctccagccactgctgctcgttgccgttgattaccgccgtaacgcccgcaggtaattctacagcatgttcggaatacaaaaacaccggtagatgaaaaccggtgcgcttaagcaacgcaagaatgccactgcgactatccgcagcggtaatgacgactgccgcgacgtccgtaaaatcagtatctcccaacgccaccacgcgacgatgagaagaaagtcgggataccagttcactactggcggcaatattcattgatttcataagcgcaaaacccgtttcggggaagtaagaataccggacaaggtgtaaaaccctgccccatgagatatgggtcaaactggtcaccagctccgaccgccagacatcagtaaaagcagaaacgctctgattttactgctgtcctgcagtgagcgtgcgttaacttcaccgcatgagcagtagcatagaaagggaaacgtttcgcgcgaaacggcgataagcgagagaatgtaaggaggtggcgtgcatcgggcaaactccatacagagaggagaaaattcgcgcaatcatggcacctttcgctaaggcgtgcaagccaggactttgcgaccagacaagccatcaacaaggcaaaaagttcataataagaaaatcaaacaatacagctaacaggaactcttgtggtcatcggcccttttatcaacgctagtgcagtattactgggtggcgttctcggcgcactgctcagccaacgcttaccggaacgtatccgcgtctccatgacatctatttttggtctggcatcgctggggattggtattttactggtggtgaaatgtgccaaccttccagcgatggttttagctacgctacttggcgctctaattggcgaaatttgtttgctggagaaaggtgtcaatacagcagtcgccaaagcacaaaatctgtttcgtcactcacgtaagaagccagcgcatgaatcttttattcagaattatgtcgcgattattgtcctgttttgcgccagcggcaccgggatcttcggggcgatgaacgaagggatgaccggcgatccgagtattttaatcgccaagtcatttcttgatttctttacggcgatgatcttcgcctgctcgctcggtattgcggtatcggtgattagtatcccattactgatcatccagttaacgctggcgtgggctgccgcgctgatattaccgctgaccacaccggcgatgatggcagacttcagcgccgtaggcggtttattgctgctggcaaccggattacgcatctgtggcattaaaatgttcccggtggtcaacatgcttccagcactccttctggcaatgccgctttccgccgcctggaccgcctggtttgcctgacaatgcgtgcaatagcggcaaagtgatgatagattgtgcagtctgaagtaaattgaagaaatttgattgacgagacgaggcgaatcaggtttaatgcgccccgttgcccggatagctcagtcggtagagcaggggattgaaaatccccgtgtccttggttcgattccgagtccgggcaccactaattcttaagaacccgcccacaaggcgggtttttgcttttggatctgacaataaccttcacgaaaaaagttagcttataaagtctgggggaattactctcgccacgttaacgagagtaattttattgatattaatctcctgatactttacccccgtccaaactccagccgctgcacattcaccatcccaggcttctcagcagcactggcatcaatttgtgtcacccgcagcgcatacttttcatccagcgcgtttaaccagttcagcaggtcattaaacaccaccggatctatccagacctgaatattctccccacgctcggctatccgcttgatgactaccgagtgcgcggaagcactgtcactgataacccgcgatacctgcgcaggcgttgttgtggcggattttcgcgccgcaataatatccggcgcggcgctcctcagtctggtgttcatcgccaccagttgctgcaacattgtctcctgttgttctatccgttcgctcaacggctgccagatgaggacgtaatatccgacgctaaacaggaacaccaccgctgccagtaacatgcccttttcacgcggagaacgccccgccaggtgttgtgccagccagtgttcgccacggcttaactggcgttcacgccattgctgaaaatagtgaataaatttatcgcgtaacatgttatttcctccgcaactttacgccgccggaaaccgcatcaccctctttctgtaacgcgtcctgttgcacaacataatcggttgccagtgcactacgcagtttgtcgaaactggcaaagttcgcggcccgtagctggaggtgaagtatctggcgtttttgatcaaaggtgaaaccacgcatttcgatgtcggaaagtgacgctgatttcagggtgctggcgatcgctgacaactcggcgagcagccgggtatcgtcggcctgtgggcgatattttttcagcgccatcgtcacctgagagcgtaaattcacaatccgcttctgctccgggaacaacgttaagaactgttcctccgcctgggtgcggctttgcgccacctgttcgctgacgctccataacgtcacgccccgctccactgccagcgcaaccagaatcagcaatatcggcagaatcatcacccgccagcgcgcccactgttttcggtagctgacgcgaggctgccacggccctgtcagcaggttcccttccggttcgccataagtggtaatggcgggcagagctgtaacggtcaggcgttcagcgtctgcgccagcccatgctgatagcttttccggtgcaatgccgactacggttagcgaaagcggtaaattctgctcattgagctgggcgcggaacatgaccggagccagcgcccgcccggcgctccatccccggcattcatcgatgcggcagataacccgttgtgcatcgccagccataaacccacaaggaatggacatccagtccggcgcgacggtagcgcgggtgatgccgttttcctgcaaccactgcgcaatgttgcgcatatgctgttggtgaatcacggctacggttgccagttgctgattgattttcaacggggcgaaatgcagttcatcgatatcctggttcagttcttcttccagtaaggcgggcagaatagtcggtatctgcttgcgggcgacatcaggcagttcaacctgccagacgctgatccattcgccgggaatgtagagtcgaatcgcatcagtttgcagccattgctggagctgttcgttagcaacgtcagaccagataccgtgctccacatcgggtgtacggcgctgccaatggatgggctcagcggcgcaaagcgggaaaaaaatctcaaggatggaactcactcactttctcctgtctgatgccagagaaccgaaaagtgttgtgggcccatgcggacaattaacgagttcatcgtcagttcaatctcattcacggtgatatctgaacgcagccagaagtaattgctgtccacgctcaggacggtttttagctgttttttagtacgctcatcgacgtcagcaagtagcggctgtgcaagaaactgatcgacatcttcccagcccttcgccggacgttgttgtaataacgcccgcgcctgaacagggcttaaccacgggtcaaacagcgcctcaagaatcacactttgcgtgacgtctaaagtattgatgttgatttgctggcgggtcatcggcagcgcacagaccagcggtttcagtttttgataaagcccggcgtccattccctgcaccacgcgcatctcgctgatatcggccagcggttgattggcggcgtagaaaggcaccgagcgggcgagatattcgctgtcttcacggcccagacgcgtctgcacgctgcggtcttcatcaataaactcccacaggctttcggctatcagttcggcccgataagcaggcacatccaggcgcgtgatcagggcaatcagttgttgtaccgcgagcggacgcgacgccgttgtgggctgagcgagggcattcaggttaaagcaggcctgtgcgtcacgcagagtgacggcgatttgcccctgcggcagtgggaaaaaacgagggccggaagcccacggctgttccagatgcacgcgcttttcatttttcaggctcagactgagcgcgctcagcgccaggctttctgcactggcgctgtaccacagcgcctgctggtactcctgctggctgcgcgttcgcccaagttgctgctgcatccgcccggaaagcgtgatggttaccagcatcataactgccagcaataccagcaccacgaccagtgccattccgcgttttggtggtgaggtgatcatgataattgcggcccgcgtaacaaccagatgcgttcaatctcgccccattgcggcgaatgcagagtcatgcgcactgccacagggatcgcctgtactgacgaccagctctcctgccagcgcgtgccgtcgtagaactgcaaatggagcgaatcggccggaatcaacttttgcattgtcggcttcacgctgcctgcggcatcggtcagcggccaggacaaccgttcgagataaccgtcatgaatgcggtaaccgacggtgagcagattgctgcgtggcatacgcatcaacgggttaaccacaccgccgcgcacaaaacgcattccttcactctcagacgccagcacgccagcgccagccagtaacgctggttcacgctggccctgatcgcctcttaccggacgcggcatcatttgggtcagatcgtgggtcagaaaactcatcgtttgctgcatgaggtttagtttttgatcgtgtccggcgacggcgctattcacgcgcgtgacgccgttagtcacctgctgcgccatcagtgccagcgaggcaaaaatggcaattgccaccagcatttccagtaacgtgaaaccagcgcgagcccttctcactgttggcctcccacggcgctaaaccaggcgcgtcgtgactgaatcaccggcgaaaagtcttcgtgaaggctgacttcaatatccaccgcctggagcagcgcgttgcctgtactcagcggtgtggttcgccagtaccagcggcttcctgccatatcgctctcgccctgctgcctgaccgcccgctgctcgcgggtcatcaggtagagcagcgcggtctggttttcagccacccagcccgctaccgttttttcctcaagaatttgctgattactcagcgcaccgctggcaatctgtaacaccgccgtggcagccagcgcaaaaatcgccagcgcgagcatcacttccagcaaggtaaatccgcgcttcatggcatcctctcatcacattgattgagggataacgcgccatcgtgcgccagttttaccgcccaacatgcgttttgcgccgccgagtagaagcgcagcgtaaacggcgtggcgggttcaaaaggcgaaaaacggatctgcggcgtcttctttttcgcctctttttgcagctccagttcaatatcgtgcagcgtcaggcgacgacgttgcagctccagcgcatattccttctgccagatatcacttccgggttgtaacagcatctgcacctgtttcggcaccgtaacctgtgctgataaccgggtcgcagaaacgggcaaccactgcccctgacgacgctgcataaactggtagccaggcgggtcgattaacacaccgagtgtttgtccttcgatcactgccctgtccttaaactgcgcaaagcgagtcagaaaatcctgcgccgcttttttcgcgggcgattcagaatcggtcgcaaaagtctgtaccacgcccgcactggcaaggccgataaggaaaatcaccagcatgatttccagaagtgtgaatccgcgttcaggcactgcttactgaaactcctgcaaattccagttaccgatatctgcgccagcgccttccccgttttcctgaccatccgcccccagggtgtaaacatcaaacagtcctttttcacccgggctgagatactgataatcattgccccacggatcttttggcagtcgtttaatgtacccacctgtacggtagttacgggaatccgccatattggccggttgttggatcagcgcctcaagcccctgttctgtggtcggataacgcccgttatccagtcggtacatatccagcgcattctccagcgccacgatatcgctgatggctttttgccgatccgctttctctttattgcccaacaggttaggcaccaccagacttgccaggacgccaagaataacaatcaccaccatcacttccagcagggtaaaacctgcccgtggtttttgtgtgcgggataacgaattcatgtgataactccgtaaattacattccaaccatattgttcagttgcagcatcggctcgaggatggcgatgacgataaacagcaccacgcccgccatcatcaccaccagcgccggttcaaacagccctaacgccagccccacctgggtatcaaattcccgttcctggttaacagcggcctgctcaagcatggtttccagttcgccgctctgttcgccggaggcgatcatgtacagcatcatcggggggaacaggcgcaactccgccagcgcggcacgcagactgcttccttcgcggacgcgatctgccgccagcagtagttgttgttcgacatagcgatttgccgacacggcggcagcggtctgaatgccttccagtagcggaacactgctggcggtgaggatgcttaatgtgcgggaaaaacgcgccgtattcagcccgcgcgcaacacggcccgtcacgggcagacgcagcaaggttttatcccggcgcaggcgcatagcaggatttttaagtagccgttgccccagcaccagaagcgccagcaatcccgccagccagtaaacgccgctggcctgtaacgcgtcgctcatggcgataagcgcgcgggtggtggcgggcagcgcgtgtccgaggtgatcgaactgttcgatgattttcggcaccactgccgtcagcaaaatagtgactacgcccgttgccaccaccagcagaaccagcggatagagcatggcctgcaatagacgtgatttcaggcgctgtcgctgttcggtgtaatctgccaggcgattgagcaccacgtcgagatgcccggatttttctccggcagcaaccatcgaacaaaacagagaatcaaagacgcggggatgttcgcgcaggctgtccgacagggtgtaaccttcctgaatccggctgcgcagcgccattccgaggctttttacatgcagtttttcactttgctcactgaccgcctgtaagcaggtttccagcggcattgctgcctgtaccagcgttgccagttggcgcgtgaacagcgcaagatctgccgccgccacgcgacgatgtgcgtgccgccgacgctgcaacatcccccctgacgaagtattcatccgggcttcaatatgcacggggataagctctttaccgcgcaacaactggcgggcatgacgcgcggaatccgcctcaatcatacctttggttttgcgaccattacgctccagcgcctgatagtaaaacagtgccattacgcctccatggttacccgcagaacttcatcgagagaggtttctccggcgagcactttctcaatgccgttgctgcggatacccgcagagtgttgtcggacataacgttccagctccagctccccggcctgacggtggatcaaatcacgcaatgtggcatccaccacgatcagctcatggatggcagtccgtccgcgaaaacctttgtgattacaggcgggacagccctgtggatggtacagagtgacggtacgggcgtcggtaattcccagcaggcgtttttcttcgtcagtggctggtgcgggctggcggcagtcgggacacagcgtgcgaaccagtcgctgcgccatcacgcccgtcagactggaagagagcaggaaaggctccacgcccatatcctgcaaacgtgtgatcgcccccaccgctgtgttggtatgcagcgtggaaaggaccaggtgtccggtaagtgaagcctggacggcgatttctgcggtttcggtatcgcggatttcaccgaccatcaccacatccgggtcctgacgcaaaatcgcgcgcagcccacgggcaaaggtcatgccgacgcgggtgttaacctgcgtctgaccgatcccttcaatcatgtattcgatgggatcttcaaccgtgagaatgttgcgcgaatggttgttcagctcctgcaatccggcgtacagcgtggtgcttttgccggaacccgtcggccccgtcaccagaaagatgccgtgcggtttgtgtaacagctggcgcaactgcgcggtcagttgctggctaagccccagacgctccagcgtcaggcgggcctggtttttgtccagcagtcgcagcaccacgcgctcgccccaggcagaaggcatggtggagacacgcacgtcaatcgcccggccgcccagcaacagcgcaatacgtccatcctgcggcacgcgcttttcggcaatgtccagccgcgccatcaccttgatacgcgacaccagcagcgaggccagtttgcgccccggacgcagcatttcatgtaatgtgccgtcaacacgaaaacggatcaccagactcttttcaaacgtctcaatgtggatatccgaagcgccttctttgattgcctctgccagcatggcgttgatcagtttgatgatcggcgcatcgtcgtcgctttccagcagctcttccgtttccggcagttcttccgcgagggtaaaaaagtcctcggcagaaccgagatcttccatcagctggcgagcctcggaagagtcccgctgccagaccgcattcagccgctgttcaaattcggcctcgtcgatttgccgcagcgtaaagggcgcgttcagcccccgctgcagctcctgcaaaacagagagcgatagcggatgaacgtggaggatctccagcgacgcttcgcaccatgccaccaggctaaaccgacggctgaaactgtagggcagacgcacggtgttggcggtggtttcctgtgctacaggcaccattaacgcgttctcccggcattgaggaacgcgcgaacttccggcggtaaggcctggttttgcgctggcagtaccggctgtgcggtgtgcggcatcaggcttaagccttgctcatcgcgatagatctgttcggcgcgcatatagttatatttgcgctgcgacacgccgtctgccgccataccgtcacgcagaatggtcggacggataaacaccatcaggttacgtttttcttttttatccgccgtcgatttaaacaggttaccaattaatgggatatcgccaagcagcggcactttcgccacgctttctcccgcctggtcgtccatcagaccaccaagcacaatcagctcaccatcgttagccagcacggtggttttcagtttgcgctcaccaaacaccacgtcgaggctggtctgtccttccaccttcgagacttcctgctcaatcaccatctgtaccgcgttaccttcgttaatctgcggcgtgactttcagcatgatgccgacttttttcctttctactgtattgaaaggattgctgttattggagccaacggtagagccggttaataccggaacgtcctggcccaccatgaagaaggcttcctggttgtccagcgtggtgatgctcggcgtggagagcacgttagagctggagtcgtttttaaccgcctgcaccagcgccatccagtcgcctttcaccacaccaaccgccgtaccgctaaagccggaaagaagctgggcgagcgtggagagatcgccgttggtatccggattaatggtggtagcgccgttttcactgatcaccgtcgagcctttctgcggtttcgcctgagaaatggctgcgcccagcgtaccgatagggatctgcgtaccattagcaaactgcattaatccggcatctttcgacgcccactgcacgccgaaattgatattgctaccttcggcaacttccacgatcaacgcctcgacatgcacctgagcacggcgaatatccagttgttcaatcacgctttgcagcgattgcatgatgtcctgcggcgcagtaacaatcagggcattactgtgtttgctggcggcgatggagacaatctcacgcccgctaccgaccgtgccttccgcctcttctttagccgccgtgagcgtgccgctgacctgcttcagtacatcgaccagatcttcggctttgctgtatttgagatagaaaacctggctgttgccgctgcgctccatttctgagtccaagcgacggatcagacggcgcattttgtcccgcgtggcggggtcaccactgacaatcacactgttggtgcgttcatcggcgacaatttgagatttcagcgtcgcaggctggttctcgccgctgtttttcgtcaggctttccagcacgcgggcgatttccgaagccgaggcgttatccagcgggatcacctcttcagtgcgattacccgcgtgatccacactctggatcacttccgtcagccgctccacgacggaggcgcgtccggtgagcataatcacgttggagggatcgtaattaacaacgttgcctgagcctgcgctgtcgatcatctggcgcagaatcggtgccagctcgcgtactgacacattacgtaccggcactactttggtgaccatttcatcgcccgcgtagttgtcgctgccttcaccgaccagcggcagcggctcgactttcgcagcgctggatttcaccaccttcagcacgtcgttttccatcggtacgacggcatacccctgtgcttccagcaggttaaggaatagctggtaatactggcgttcattgagcggggtcatggtgcgaatactcactttcccctgtacgcccggccccataatgatggttttattaaggttagcgccgacggtttcgatgaacgatttcaggtcggtatctttaaaattagcggtgaaagtggcttcttccgcccagaccggtgaactgcataatgccgctgccagcaccagcggcagtaaacgcttttttgttttgaggccagttgtcttcttacgccagaccgacaacgtaatatcacgccaaaacacgatgaatgattctcctggattaaatgcggttagcgcagcgcgatggaaatgtcgtggcgcgcacccttgcgtaaaaccgtaagttgaatggaatccattgaaggtaactgccgcatcagagcaatcattgctcgtggatcagtgaaatcctgctgatttagcgcaatggcgatatcgccttccttgaaaccgctggcatcgaacagagaacgatctgcccccggcttcactgcataaccgacaatcccctccttacgcacaggcgtaagctggatatagttaaaaattttctgcggatctttcgtcagtgcctgacgcacggcagtcgggatctcaactggcgcactggcagcaggctcagcaacagcttgctttgcttcgtcactgacggcttttttgttggtcacggctacggtggaatgcccctcttctgccaggctcaggcgctctatttttccctgatagcgcagcatcacatggtcgcggttgatttcctcaatcaccgcgttgtgagaaccaagccgttccccctgcaaatagacctgctgtttgccaccttcttcaataaccgcgccgggtctggcaccaaaggcgatcccacgcaacaccacattaagacgcgtttctgccacaggcacaggttcgggttgttttaccggcgtggcgacgggctgatatttgccaaaccagttttgctggctgattaattgcacgtcatttttatcgaacgtttttgcatccgcacggggcggtttattcgccgatggggaaacagccgtatattccgcagaaaaggagaaatagcgccagagtgaatacgccatttttgcagaaataataagcagcatcagccagaacatcccgcgtgcaattttgcgcagatgctctttgtctgtattaagagattgtctctggttaagagtgtgacgaatttttgtcagccattgaatgagataaattcgtgcgtcacgaaaaacaacccgcgccaatttatatctacccgacgttatgctttgactattccacaggtggtacgatccagtttccgctgatactggttacctgtacgtgtatcattaatcgttatgctgtaattaattccctcagtgagcattaatttcaccgttgggtcattgcacatttgtcgttgatagctggttaaaaaggcgtcaggcgtctgcgtggtctgagtccccgcttcgctgataatggtcatttttaccgtcgtgccgctactttgtgccagcactaaggtatatcccgcagatttaatcggcaggttttggctgatattttgcgcctgttttttcgccagtaaactggcattttcattatggctggcacagccacttaataatcctgtaacgctcagcaatagcgatattaataccctccctggcatttgttttatcgacatggtaaataatctctaaggttattaataagagttaaaatgtcactttgataatgacgttgttatcattaaaacaatgcctgtagataaattgttgctataccgcccagacttaaacacggtccaaaaggcagtgtggttgatcctctttttgtaataacggcatatatcaggccgcagcatgatgcgattaaagcaacattgggtagcgacaacggccccacccaactacctaacgcagcgaacaataatacatcgcccatgcctaatgcttctttacgcagaactattccggctatccagcgcagggagtaaaaagcgataaaccccaccaggacgccggtaactgcatcttgtagcgtgagcgggctctgctgcgcccatgccgcactcagtcccgtccacaatacgccctgagtaaaaacatcgggcagccattggtgatcgaggtcaatgacgctcgcggcaatcagccaggcggataatatcatcaccgccagcgcccatccactttccggccagaccagactcgccagcaaaaaagcgagtgccgtcaataactccaccagcggataacgcttgctgattttcgcctgacagtcgcggcagcgccctttgagcatcagccaggagaacagcggaatattgtcacgtatccggatggtctgctgacaatgtggacagtgcgaacgtggcagcgccaggcttatttttgactgcgcactcggcatttcaccgtgaaactccgccatttgttggcgcagcatgatggggtaacgccaaatcaccacattcaaaaaactacctataatcaatcctccgacggttgccaggacgggcatcgccgcggggtattgctgaaaaacatcaaaaagcatggttaaaggttgtttgttgtaacttgccggatgcgggcctgcaggtgtatgccatatggctttcctccaggcccgataagctggcgcaacccggtgcgccttatttcatgccggatgcggcgtgaacgccttatccgggttattcagcaggcatcgaatactcggtaaccttgttaatggtttccggcccttgcttcggtttcggcagatcgagtgacgcgagcgtgttgtaagccgactggctcacaccgccctcgaagctcatctctgtcgctcccggcaactggtaagcattcgcgcccggattccatttcttaaagaatgcggaaaggtccgtctgagcgacccaggatgcacacagcatcagcgtgtcggcagcgttaccgttggattcggcacagtagtttctgttgccaaatttgtcattgccaacatcatcgccgcgtgctttacggtgcatcaactggaacaggttccagcctttcatcccttcacgctcgctgtagaacgctggcagagagccttctggataccactgtttgatatcaaagtttttctctgcccattccttcagctgcgcgtacatcagcagacggtcacccgcaccgccacgcgcccatgcctgaccgttgctctcctccagatattccggcgcaacggtaatatcgtcagcgacacggttcatcttgccgagataacgatcctgcatgtacagcgccagcacgttgttcgccacttcagttgcgcccggtacagtcagcggcgtttctgcagcgttgtgccctacttcgtgccagatcagccagtcgttcagcggcgtcgtcggcagcgtggtgctgttcggcgagaagctgctgttcatcaccggataaccagagtgcgcatcaccgatggagatctgcacatcgttggtgaaacgatgtttgtgccccgtcaatgcttcataggtaaacatccggtgcttaccgctttcgccatcacgaccgtagaagtcattcatcgagctggcaaaggtatccagatcctcagcgaattgtttcagaccgcccttgtaattgctggcctcaaggttcttcttcggcgtggtatagacgaacgacgcagactccagctcacccaacggcgcaggggatttcaggtcgtttttccatttaccgtctttatagaacggcgcttttaccacgccagtaaaggtgaagttggctgatttctcctctttactgtcgctcttgatataaatcagaccaccgtaaggaaccttgaacttcaccgtgccgctagcatccagagagtatgttttagtcactcttggcggacggttcagcgcaacctcatgcttctcacgcccggtcaggtcgtcagccagcgccacggtaacagtcacagggactttcgcattggacttaatgctgacttcctgctgagccggagcccacaggccagtagactgcatgttacccgcaaaccatttggtcggattcgagtacaggttgatggtttcagtaacctcctcaccttcagccgataccgcccccggatacttctcgacatcaaccttgatgttcagatcccaccaggaacgccccagcatcaggcgcgtcagcggtttttccatatagttaagcgggtagctcgggttcatcatgcccgctttgctgccttcaccgtagatcatcttgttatcgatcagcgattgtttcagctctgcggagcactgcgtgccaccatcataagcattgttggcgtaacagttcaggaactcggtgaacgttttaaagcccagctcgtcatccttgtcgttttcatagcgatattcaattttattccacagccagaccgacatgttctggtacagacgttccagatcgacgctgctcagacgctcacctttgcgaccattggtacggaagtaaagctcatgctgatacagacgctgaatgttggtgcctaaatccgcagcctgcaccatcgctttcgcagtgtcggcgttaaggcttagttgcgtatactgtggaacatacatgccaccagtaaccggaacccccgtgccaggacgatattccagacagttgacctcatagtggtagtcagaatccttacactcttccagccctgggaacgcgtccagaattctcttcttcgccgcagccagtgactcaggcgttttgtggtcggcttcatcgataaaggcgaattgagttacctgtttaccctcaacttcttcctgccagctggcaacttccagcttcggtttgtcatcaggtttgttttcttgctgatatttccagataacttctttcgtggtgtcatcaatggtatacggtggtttaccatcgacagccggataacgctcatagacccaaattggcgttgaacgtcgttgacgaacgcggtccgggtagccttgcggatcgttatttactaccgacttgttaagcgccatcgacaaacctgcggcatcaagcagacgtacaaagccagatgcgctctcttccttaagattgctcatcacgttttccatgatcagcaccgatccacctttgttcatataggcgatcaaatcggtcacatcctgctgggtcagcttcggtttgctggtatctgcacgcagcgggattgcataaggatcgttaccaacctgagtcacatactcaaagccgttgaggatcagcagcggcatttcctgcgggtcgagatcgccatagctacttaaatgctcaacagagatacccgcaaaatccggatgaaagccgaacgcagcactatttcctgtaacctgcccgtgttttttgaaatacaccgtgtccaggttagtacccacggtcatattggattttgcatccggcaaccagcgatcatttgacagatagcgcagcacgttctccatgaagttcttcatgtcatccgggtcgctgttgagcgtacactgcccatctttattaacgcccccgttccagctgtaaccgttcgggcaacgcaggatgctgttgtagtgtgggttaccgataaccatcagcttgccatcgcccacttgccccagcgaaataaacggcaggttgaaggtggcggtttcgcgtgtcacgttctctggtcgcacaatggaaggcgcttcagtaatgtacgccagctcatttttatcccaggcccgtttctcgccgaaggccagccagtagtttttatcattacgcgccatcagaatcgggaaggccgcgttggagatattcaccaccgcctgaccgcgcgcattacccgtgctgccatagaagttggtggagtcatggaatacatggaacttgctgacagatttgtagttcgtatccacgccccacagcttgttgataacgccctgaatctggccgtcattaacattgcgcgtcgtcagcgagaaccagcgagcctcgttacaaccatcggttttcgcacaaatcgcggtatcgatctctttggcctgacccgtattaaactgctcaataaattcgttaggcagattaacgacttgctcaccttcccccagcgtcgcaccgttggataacgagagattgataatctcgttgatcacgttgggatattcggcaaagaccttgcgtacatcgtccggaacaacacgggtattattttgcccggtcgtcgaatagcgatgaataagctgatcaatattcgccccgcgaacttcatcacccagttcagtcagcgcaatggtcgacttattgccgcgcactgaacccagttcaaaggtatcgataccaaaggagatggtttcgccccagctaaaggaaaattcaccattttcccctgtcacgccacggcctgaattggtgtagtagttgacgccagcaacaccatatccctggctatcgaccagtcgaccttcagagagaatgatttcagtgggttgatactgataaaactgttccgcgttagccgacacgaaggaagcgttcagatccggttttgttcccggcgtggtgacgggcacgaccggtgaagtatgagtggatggcgctttatcggtcgcagcattgttttccacctcttcattgaccagctttttgaactcttccggtgccagatcgatttgcttatacagcgagtcgaagcgtttactctcgatcaccgaggagaacgtcagacaaacctgttctgtattcgccggacagctgttactggacgttaccagcgaaaccgcattgcttttcttgtcatcggagcccgccagttcttgcgcgtcctcaaggctaaacgacactttttcaaccgcacgcaagctacgcgcagcttctgactgagtgttgaaggtggcaattgtcgtgttacccgccacgcaagtaacgtcctcgccaggtttaaatgtaaagccatcgctggattcaccattacaggtagcaccagttacccgctggcttccgcccagggtcagataacccgttttcgtaggaacaggttctggctccggttctggtgttggttcaggatcaggtatcggttctggcgtaggctctgggtccggcgttggctcaggcgtcggctccgggtttggtgttggatcaggtttcacttccggcaaagatcctgttccagaatctacaggcggcgtatcggaggaagatccggaaccaccgccatcacaaccggctaacagggttgcgctcaaaatagccgctaaaagcgatttcttatatttaaatttcttattcattaataacgcaagtgacaaaacaatgttaaaaaattcgtaactgggagaaatagttttatgctttatcttctctaataacttcctccattcttaagaaaacgacatcattgatagaaaacaggtgaaatttataagaataacccctatacgatgtctatctggctatttttacgaaatttcaacaaacaaaaaattaacaacatttcacaacgtaactatataaatttgttggtagttttaacgattaagattgcaaaagcaacagatagaacggtgtttgctcatcaagcgaacataattaatacagacttgttttgcgtgataaaaaaatagatgttctcacgctcttaattatttagcaggttatctgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaactgcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgagcgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattaccggttatctgaacgcaaaacattattgctgcatggataataaagcgagaaatgattttcaattaataagacagaataatgtaaatgaagccggatgatattaacgatcatccggctttattgatttacgagactaacatcccggtaaacacatacgcctgcagcagggtgataatgccgataacgctggcaaaaatcagactgtgcttcacggtgtagcggaacagttcagattctcggcccaccatgcccgtcgcggcgcaggccacggcgatagattgcggggagatcatcttgccagttacgccgccgctggtgtttgctgccaccagcagggtgtcagagacgttgatttgctgcgccgtggtcgattgcagtgaaccaaacagggcgttagaggaggtgtccgagccggtaaggaatacgcccagccagccgagaaacggtgagaagaacgggaacatcacgcctgtacctgccagtaccagcgccagcgtggtggacatgccagaatagttggtgacgaaggcgaacgccagcaccatgccaatcgacagtatcggccacttcaagctaattagcgtttcggcaaagacgccaatacctttcttgatccccacaccgaggatgaagatagagataatcgccgcaataaaaatagcggtgccgccagccgagagggggtcgaatttaaacaccgcatccattggcgttggttgggcgacaatgggtgccgctttcaacacttgttgatgcaaatgagggatctggaaattaatcaccagtgaataaaacgcgccgcccggagcaaataacgctttaaacggcttcatggtccagatggtgaccagcaccgttaagattaaaaacggtgaccacgctcgaatgatttgccccagactatattctgaaggcacgggaccgccagaagatggcttatttaccaccatcgcacctgcggattgtcccatgctgattgccgtttcggtatttttcggccgccagactttaaggaataaagcgagtgagacgatactcaccagcgccgaagtaatatccggcagttccggaccaatatagttagaggtaaagaactgagtgacagcgaagcttcccccagcaaccagcgccgctggccacgtctctttcacccctttccagccgtccatcattgctaccagccagaacggcacaagaaccgacaggaacggtaactgacgtcccgccattgcgccaatgtggaacggatcgattcccgttacctgaccggcgaccagaatcggcacgcccaacgcaccaaacgccaccggcgcagtattggcaatcagacacagccccgccgcgtataacggtttgaagcccaggcccaccagcagcgcaccggtaatcgccaccggcgcaccaaagccagccgctccttccagcaacgcaccaaaggagaaaccaatcagtaacacctgcaaacgctgatcgtcggtgatggagataaccgagctgcggataatatcgaactgcccgctggcaacggttaatttatacaggaacaccgccgcgacaataatccacgctattggccataatccataaataaagccatagcccgcagcagcaaatgccatatcaatcggcattttaaaggcgaatattgcaatcaggatagataatataagggttattgctccagcgacatgtcctttcagacgtaataccgcgagtgcaacgaagaagaatattatcgggatcagggcgaccagagcggatagccccagtcctcccatcggcatatacatttgggtccaggtaaccatattgttcagtctcttattatctttatatgcttgatatacttaaggttgtaataagcaaaagaggactgaactgtaaaatataggcgttatactttacagcaacagtacgccgctaacgcaattgctacctctggcataacaagtatatcgggtaagggtttctgttccgcacacgcagacgcagagtatcgttaagatgtccatattgttgttttaggcccgctagtaatgcgctacgggtatttaatattgttaaaccctgataatcgctccggttatttccgggataaatgtactaccgcagttactatcatagccccgacaataaaacttgccggggcttttttgacgctattaatgactttctttttcgcgtaaacgccaggcgtgtaataacggttcggtatagccgtttggctgtttcacgccgaggaagattaaatcgctggcagctttaaaagcacacgagttagcgaaattccccgccatcggacgataagccggatcgccagcgttttgctgatcaaccactttcgccatattctccagcgacgcctgcacctgttctttggtcagaataccgtgacgtaaccagttggcgatatgctggctggagatacgcagcgttgcgcggtcttccatcaacgccacattgtgaatatccggcacttttgaacaaccaatcccctgctccacccagcgcaccacgtaccccagaatcccctgcacgttgttatccagctcttgttggatctcttgcgccgaccagttagcgttttcagcaaccggaatagtcagcagatcgtccagcagcggttcaaattcagcattgaactcggtctgggcaatgttggcttgtacgctctgtacgttggtttggtggtagtgcagcgcatggagcgtagcagcggttggtgacggaacccaggctgtgtttgccccggcacgcagttggtcgcccttctggctgtacatgtctgccatcaggtccggcattgcccacatgcctttaccaatttgcgctttaccgcgcagcccacagaacagaccggaaagcacgttattacgctcgtaggctttgatccaaggcgtcgatttcatctgatttttacgcagcatcgggccagcttccatcaccgaatgcatttcatcgccggtacggtcgaggaaaccggtattgatgaacgccacgcggttgcgcgcctgagcgatacagctacgcaagttcagcgaggtccgacgttcttcatccataatgcccattttcagggtattcggtgccataccgagcattgtctcaatgcgggtaaacagtttgttggcgaacgccacttcctgcggaccgtgcattttcggtttcacaatatagacgctgccagtgcgcgagtttttctgcacttttaaatcatagagggcaatcgcgccagtcatgacgccatcaagaatgccttccgggatttcattgccttcgctgtcccaaatcacaggaatggtcatcaaatgacccacgttgcggataaacagcagcgagcgtccgtgcagagaaatttcagagccatcggcggcggtgtaatgacgatcgtcattcagtttacgcacgatttgccgaccgtttttctccattttctcttgcagagtcccctgcatcaggcccagcaggttgcggtacagcaggattttatcttccgcatcaaccgccgcgaccgaatcttcgcagtcgagaatggtactgatagcagcttcgacgataacatcgttgatgtgcgccggatcgtctttgccaatccgcccattggcatcgatttgcagctcaatatgcaggccgttatttttcagcaaaatgcaggtcggcgcagcggcatcgccacggtaaccgacaaactgtgctggagtacgtaacgtggtttctttaccatttttcaactggatgcgtaattgtttatcaaccaccttaaacgccaccacatcctgatagctgccgttttccagcggtagagattcatcgaggaaacgccgaacccaggcgataacctgctcaccgcgttgcggatcgtagccgctgaccatcgccccttcctgcgggatgatgtcgctgccgtataacgcatcgtacagtgagccccagcgagcgttcgccgcgttcagcgcgtagcgggcgttcattgccggaaccaccagctgcggccccgcctggctggtgatttcgctgtcaatgcccgtggtttccaccgtcacgcgctccggttgcggcaccaggtagcccagttcacgcaggaaagatttataggccgctttatcttttaccggccccggattgctgcgatgccactcatcaagcgctgcctgaatgcgatcgcgttctgccagcaactgacgattttctggtgccagatcatgaacgatctcatcaaaattgcgccagaacgccgcagcgtccagccctgttcccggtaaaacttcttcatccacaaaacgtttaaaattggcgtcaatgcgtaaacggctctgggttatggtttgactcattgtttatctcctcgttttcgcttatttcgccaacaccgctgctgccgctttcgcgacctgcgcatcctgtgctccggttaaaccagaaacgcccacggcaccaataatttgcccatccacaacaaccggtacgccgccttccagcgacgttaataacggcgcagtcacgaacgcggtacgtccgttgttcaccatctcttcatagcccttagtttcacgacgccccagcgcggcggtacgcgctttctcctgggagatataagccgcaatcggcgcgcaatcgtccatgcgacttaacgccagcagatgaccgccgtcatcggcaacagcaatggaaacagaccagttatttttctgcgcctcttcctgacctgcggcaataattgcactcgccatttgctggctaagaatgactttagttttcattttgttattccttttcaagggcttgttctacaatttcaatccagtgacgcacagaggtacgaccggcgctcgccagatgcgtctggcaaccaatgttggcggtgacgatcatttccggtttgccgctttccagcgcattcattttgttatcccgcagctggcgtgccagatcgggatgcgttaacgcatatgttcccgctgaaccgcagcacagatggctgtcgggaacgtccgttaaggtaaatccaagacgaagcaacactttttccacttcgccgttcagcttttgcgcatgttgtagggtacacggacagtggaaggccagctttttatcgccgcgaattgccagtttttccagcggttcctcgcgcagaagttcgactaaatcgaccgccagttcactgacctgacgcgctttatcggcatataacgcatcgtttttcagcatctgcccatactctttgacaaacgcgccgcagccgctggcggtttgcaaaattgcctcggcacctgcttcaatcgcgggccaccaggcatcaatattattgcgcgcccgtgccagccctttctcctgcgcattaagatgatagtccaccgcgccacaacagcctgcttcgttagctggcatgacgctgatccccagacgatccagcactcgcgcagttgccgcgttggtgttgggcgaaagcgtaggctgggcgcagccttccaacattaaaacccgacgcttatggcgcagcggcggacgcggtttagctttcaccgtttcagcaggcagttttgctctgacctgttccggtaaaaacggtcgcagcaccagccctacctgcgtcagcgcacggaagaccgccggacgcggcactacctggcgcaatccttcgcgcagtattcgctccggcagtgggcgtttcactttctgctcgacaatatcacgcccgatatccagcaaattgtgatagcgcacaccagaaggacaggtggtttcacaattacggcaagtgaggcagcgatcgagatgctcctgtgttttaagcgtgacttcgttgccttccagcacctgtttaatcagatagatgcgcccgcgcggcccgtccagttcatcgcccagaagctgataggttgggcaggttgcggtacaaaatccgcagtgaacacaggcgcgcaggatgctgtcggcttccagcgcgcgcgcgttctgccgcatctcttcagttaattgggtttgcatagcctgctcctcaaagttccgcgtacatgcgaccggggttaaacacgccgcaagggtcgagctgctgtttaagctgctggtgatagcggaataaaggagccgatagcggggcaaagccaccatctccggcactaaagcgggtcgcatgaccgccagcgttgcgggcgatgcgatggatttgattgtcctcggctgtcgatttcagccagcgtaacgccccgccccagtcgatcagttgctcgccgggtaaatccatcatcggcgcatcactgggtaatgaaatgcgccataaggtacctggtaacgagaagaacggcagttgttgttcacgcaattgctgccagaactgaccggcaacctcttcgccacccagcagttcacgcgctgcttttaccgatccttcgccgccctcaaggcggatccacaacgcattgtcgaagtaacataagccactaatgggtaatggctggagttgccactcggcgatttcactcatggcttcttgcaggctgatttcccgacgcaggctcagggaggcgcgcggtcgcggtaacactttcattgagatttcagtgagcacgccaagacaaccgtagcttccgaccattaaccgtgagagatcgtatccggcaacgtttttcatcacttcgccaccaaaacgcagatgttttccagcgccggtaatgatgcgcgtgccgaggacaaaatcgcggaccgaaccgctccacgggcgacgcggccccgccagcccgcaggcgaccatcccgccccaggtggcttcttcaccataatgcggcggctcacaggggagcatttgccccgcgctttccagcgccgcttcaattgtcaccagcggcgttccgacacgcgcggttatcaccagctcggtcgggtcgtaattaacaatgccgcgatgacaacgaacatccagcgtttgcccggtgacagggcgacctaaaaaggctttgctattgctgccctgaatcaccagcggcgttttatcgctaatcgcctgattcacctgctccagcagcgcctggctgtaatcacactcgcgtagcatcagaaacgctccagttcagggaaaggtaaatgaccgtgatgcacatgcatggcaccaaattcagcacagcggtgtagcgtgggaatgtttttcccagggttcagcaaaccatcggggtcaaacgccgccttgaccgcatggaaggtcgtgatttcatcgctgttgaactgggcgcacatttgattgattttttctcgcccgatgccatgttcgccactgatgctgccgccaacttcaacgcagagttcgaggatcttcccgcccagctcttccgcgcgggcaaattcaccgggttcgttggcatcgaaaaggattaacgggtgcatgttgccatctccggcatgaaagacgttggcaacacgtaaatcatattgctgcgataaacgggcaatgccttccagtacgccaggcagggcgcgacgcgggatggtgccatccatgcagtagtaatccggggagatacgtcctaccgccgggaacgcatttttgcgaccggcccagaaacgtacgcgctctgcttcgtcctgtgccagacggacgtcagtcgcgcccgctttcaacaagatgtcgttaacccgctcgcagtcttcctgtacgtcagactccacgccgtccagctcgcataacaaaatcgcttcggcgtcgacgggataaccggcatgaataaaatcttccgccgcgcggatcgacaggttatccatcatctccagcccgccggggataatgccattggcgatgatgtcaccaaccgcaagtccggctttttctaccgagtcaaagctggctaacagaacccgcgccacgggcggcttcggcagcagttttaccgtcacttcggtggtcacgccgagcataccttccgatccggtgaacagcgccagcaggtcaaaaccaggtgaatccagcgcgtccgatcccagcgtcagtgcctcgccgtccagcgtttgcacttcaattttcagcaggttatgtacggtcagaccatatttcaggcagtggacgccgccggcattttcagccacattgccgccaatggaacaggcgatttgtgaggaagggtccggtgcgtagtagagattatgcggtgcaacggcctgggagatcgccaggttacgcacgcctggctgcacgcgcgcgcggcgaccaacggggttaatgtcgaggatctctttaaagcgcgccatcaccaacaacacacctttttccagcggcagcgcgccaccagaaagcccggtgcctgcaccacgggtcaccaccggtacacgcaggcgatggcagacagccagaatcgctgtcacctgttccatttgcttaggcagaacaaccagtaatggacgcgtgcgatacgcgctcaacccgtcacactcgtaaggaatgatctcctcatcggtatgcaggatctcaagtccagggacatgctcacgcagtgccatcagtaccgatgtgcggtcgacatcgggtaaagcgccatcaagacgctcttcgtacaagatgctcatgagtaggcttcgctttgttgtgttgtgtggcagctgatttttgcgcgctgcttctgtgaacagttattaagcgggcttttcgttttcgtctatctctttagctaccggtcagaccattttttttccagctctgtgaccttgtcttggttaactaaatgttaaattgatgtaacataatcacttacgtgatgtgcgtgttttgcgagttaagaacagaaaaattggtcctacctgtgcacgaggtccgggaatgaaagatgaacgtcgccctatttgcgaagtggttgcagagagtatcgaacggttaattatcgacggcgtactgaaggtcggtcagccgcttccctcggaacgtcgactgtgtgaaaagctcggcttctcacgctccgcactgcgtgaagggctgaccgtgctgcgcgggcgcgggattattgaaacggcgcagggtcgcgattctcgtgtcgcacggcttaatcgggtgcaggacaccagcccgctgatccatctgttcagtacgcagccgcgaacgctgtacgatctgctcgacgttcgcgcattactggagggcgaatcggcaaggctggcggcaacgctgggaacgcaggctgattttgttgtgataacccgctgttatgaaaaaatgctcgccgccagtgagaacaacaaagagatttcgctgatcgaacatgcgcagttggatcacgctttccatctcgccatttgtcaggcttctcacaatcaggtgctggtgtttacgctgcaatcattgaccgatctgatgtttaattcagtgtttgccagcgtaaataatctctaccatcgaccacagcaaaaaaagcagatcgatcgccagcatgcgcggatctacaacgcggtgttgcagcggctgccgcacgtcgcccagcgcgcagcacgcgatcatgtgcggaccgtgaaaaagaatctccacgatatcgagctggaaggccaccatttgattcgctcggcggtgccgctggagatgaacctgagttagctggtattaaatctgcttttcatacaatcggtaacgcttgtacggctccgccccaatgcgttccagcatgttattcatgcctgtattggtttcgaggatccatgacatctccagcgcatcgatcttccggcgggcaaacggatcgcgtaaggcttcaatcaataacagcgcaatcaccgggccgatgcggctgaactgatactcgtcgcgcacgcccatcagcggtactcgcgcagttcgcacaccgctgactttcaaacgccacagcaattttgcccagccgaagggaaagagcgatccgttcagatcggcaatcgcctcgttgatgttcggcaagccgacaataaacgcgcagggtgcagaatcaatctcagcgatatagatcatatcgtccggcaccagatatttaagttgatcgcccatggtcgcgaattcatgttcggtaaacggcacaaatccccagttgtgctgccagccagagttgaaaatctcacgcaggatctgcatctcttcggcaaaccgctgacgattgatgcagcgaatggtcacctttttgcgcacctgatccatcagtttttttagcgccggagagaaagtgagatcggttcgctgcatccaccacgccagtaaatcaatgcctttgtgataacccagttgttcaatatgcgcggcataccacggtttgccgtgtggcatcatcgcacagggtggtgtgtcaaaaccttcaatcagtaatccgctttcctgattgatattcaggctgaaaggcccgctgatcttacttgcaccttgtgacttcaaccacgcttccgctgcgccaaacaacgcggcaaaaacctgcggatcatcaatggcgtcaatcatgccgaaatgaccggtatctttgccgtaacgctcgcggtgcaaggtatctatttgcgcggtaatacgcccaactatctgccccgctttttttgccacccacgcctgccagatgatatggtccgtccccggatttttcgcagacaaatgctcgttgcgttcaatgaataaagggggtatccagtttggatcgtcgggataaagtgatgacggaaaagcgataaatgccttaaggtcatttttattaattactttttcaattttaatcatcagcagatcgcattccatagttctgttctgtgggtaacaaataattaacggtgacaaacaggttgcaacagcaacgaacggcaccttaataatcaacccaatgaatacaaacgacgaataaatagtatttattaatgattacgataaggtcagagactacacagaagcgccacaatgccttttgtcgatttaaggcgaccggacaaggcttcttcttaatatattcataaattaaatatcattcacaataaaaacaaaaaaactcaaactcattatttaaatcaatgttcattttcacactgatgaaaatactatctcatttatcttttatgcctatataatccaccgcattattgtcattttattttggatatccaattttttcgtggtgtatatgtctaataaaatctttacgcattccctacctatgcgctatgccgattttccaacgctggttgatgctttggactacgccgctctgagtagcgccggaatgaatttttatgacagacgttgccaacttgaagatcaactggaatatcagacgttaaaagcacgtgccgaagctgttgcgaagcggttgttatcgctgaacctgaaaaaaggcgatcgcgtggcactgattgccgaaacaagtagcgggttcgtagaggctttttttgtctgccagtatgccggcttagtcgccgtcccgttggcgattccaatgggcgttggtcagcgggattcctggagcgccaaattgcagggtttactggcaagttgccagcccgcagccattatcactggtgatgagtggttgccactggtcaatgccgcgacgcatgacaaccccgaattacatgttttaagccacgcctggtttaaggcattaccggaagccgatgttgcgctccagcgtccagttccgaacgatatcgcctacctccagtacacctccggcagcacccgttttccccgtggcgtcattatcacccatcgcgaagtaatggctaatctacgtgctataagccacgacggcattaaattacgccctggcgaccgctgcgtctcctggctgcctttctaccatgatatgggactggtcggctttctcctgacccccgtcgccacgcagctttcagtagattatttgcgcactcaggattttgccatgcgtcctctgcaatggcttaaattgatcagtaaaaatcgcggcaccgtttccgttgcgccgccgtttggctatgaattgtgccagcgccgcgtgaatgaaaaagatctcgctgaactggatctttcctgctggcgcgtcgctggtattggtgctgagccgatctccgcagaacaactccatcaattcgctgaatgtttccgtcaggttaactttgacgataaaacgttcatgccgtgctacggactggcagaaaatgcgctggctgtcagcttctctgatgaagcctccggggttgtggttaacgaagtggatcgcgacatcctcgaatatcagggcaaagccgtcgcgccgggtgcagagacacgcgccgtatcgactttcgtcaactgcggcaaagcgttgccggaacatggtattgaaatccgcaatgaagcaggtatgccggtcgcggaacgtgtggtaggccatatttgcatctccggtcccagtctgatgagcggttactttggcgaccaggtttcgcaagacgagattgccgcgacgggctggttagacaccggcgacctcggttatctgctggacggttatctgtatgtcaccggacgcattaaagatctgattattattcgtggccgtaatatctggccgcaggatattgaatatattgcggaacaagaaccggaaattcattctggcgatgcgattgcttttgttaccgcccaggaaaaaatcattttgcagatccagtgtcggatcagcgacgaagaacgtcgcgggcagcttatccacgcgctggcggcacggatccaaagcgaatttggcgtgaccgcggctatcgatctgttgccgccccacagtattccccgaacgtcctccggcaagcctgcccgtgcggaagcgaaaaaacgttatcagaaggcttatgctgccagtcttaatgtgcaggaatccctggcatgaatcaaactgtcgcggtgacgggcgctaccgggtttatcggtaaatatattatcgataacctgctcgcccgcggctttcacgttcgcgcattgacgcgtactgcccgcgctcacgtcaatgataatctcacctgggtgcgcggttcgctggaagatactcattcacttagcgagctggttgccggagccagcgcagtggtccattgcgccgggcaagtgcgcgggcacaaagaagagattttcacccgctgtaacgttgacggcagcctgcgcctgatgcaagcagcaaaagagagctgcttttgccaacgttttctgtttatctcttcgctggcggcgcgccatcccgagctctcctggtacgcaaattccaaacacatcgccgaacaacggctgactgcaatggctgacgaaattacgctgggcgtttttcgcccgacagccgtgtatggtcccggcgataaagagttaaaaccgctgtttgactggatgctgcgcggcctgctgccacgacttggtgcaccagatacacagctctctttcctgcacgtcaccgattttgcgcaagcagtgggtcagtggttaagcgccgaaactgtacagacgcaaacctatgaattatgcgatggcgtcgctggcggctatgactggcaacgcatacagcaacttgccgccaacgtccgttgcggttccgtgcgaatggttggtattcctctgccggtactcacctgccttgcggatatcagtactgcgttgagtcgcctggcgggtaaagaacctatgctgacccgctcgaaaattcgtgaattaacccacgccgactggtcggcaagtaataaccgtatttctgaagatattaattggtttcccgggattagcctggaacacgcattacgcaacgggctattttgattgtcttgtttaaaggtgtgttaacgtttctatggtaaatcgtgaaatagtaatggattacatcctttcctgtttacaggatttggtcgaaaacggtgtggaaattaagcccgacagcgatctcgtcaacgatcttggcctggagtcgatcaaagtgatggatctcttaatgatgctggaagacagattcgatatttccattcctattaatattctgctggatgtcaaaacccctgcgcaattaatggaaactctacttccatggctggagaataaataatggggctatacgataaatatgcgcgccttgctggcgagcgactgcaatttagtgacaacgggttaacaccgtttggcacctgtattgatgaagtgtattccgccaccgaaggccggatcggcaataaaaaagtgattctggccgggaccaataattacctcggtttaacctttaatcatgatgccatcgccgaaggtcaggcagcgttagcggcccaaggcaccggcaccaccggttctcgtatggcaaacggcagttatgcgccgcacctggcgttagagaaagagattgccgagtttttcaatcgccctaccgctatcgttttttcaaccggttataccgctaatttaggcgtcatcagcgcacttgccgaccataacgccgtggtgttactggatgccgacagccacgccagtatttatgacgcctgttctctcggtggcgcggaaattattcgtttccgccataacgatgctaaagatctggaacggcgcatggttcgcctcggtgaacgggcgaaagaggcgattatcatcgttgagggcatctacagtatgctcggtgacgttgcgccgctggcggaaattgttgatatcaaacgtcgtctcggtggttatttgattgtcgatgaagcgcattcgtttggcgtgttaggcgcaacggggcgcggactggctgaagctgtcggcgttgaagatgatgtggatattatcgttggtactttcagtaaaagtctggcctcgattggcggttttgctgtcggttcggaagcgatggaagtgctgcgctacggcagccgcccgtatatttttaccgcctctccttctccgtcctgcattgcgaccgtgcgctcatcgttaagaaccattgccacacaaccagagctgcggcaaaagctgatggataacgccaaccatctgtatgacggtctgcaaaaactgggttatgagttaagttcacatattagcccggtagtgccagtaataatcggttcgaaagaggaaggtttacgcatctggcgcgagcttatctcgctgggcgtgtatgtgaatcttatcctgccgcctgccgcgcctgcaggcatcacgctgctgcgctgtagcgtaaatgctgcccacagtcgtgagcaaatcgatgccatcattcaggcatttgctactctgaagcagtaatgtgagcccgccgtggtgtttgcgccacggcgggtttaatgttgtctgtcataccaatacaccaggctcaacgccaccaacacaaacgctaccggtaaaccgagcgcggtaacaggtgcgcttaacgcaaatagcaatcccaaattgaccatgatttgatagctgatccaggtgagtaagccaacgatgacgcctacagcgagacggctacccatccctggcgagcgcggggcgctaaaggtaaacggcacagccagcaaaatcatcgccagggtcaggatcggttgccccagtttttcccacagtgcaaggcggtattcgctgctgggttgcccggtttcctgcaaataatggatgtaatgattaagctgacggacagaaaaagtattccccggcatcgataactcatcaagatccatactggtgaaggccgattgccaggcaagattatctgatgtttccagcgtttctttaccgttaagccattttttatgattcacaccatgcaggatccacgttttgtcgtctttaatggtggcactgcgtgcataaatgtaggattcgagcgaaagatcgtcacgataatgaaaaatctccacgcccacaggctggccctgttcattcagcgatttcaccgtcacaaattcattgccgcgcctggcccacagcatattgccggtaatgtcatcgtcctcccccaacgcggtggcggtcgatttgatttgcagcgcctgttgctgcaatggcgacgccacccactcatctatcgcgcctaacgaaacagtccacaatatcccggcaaccagcgccaccagtgcaatacggaagatagaaaaccccgtgctgcgaatggcggtaagctcactgtttttcgataactgccccaggccaacaatccctcccaataaggcgataaacggcgaaagttcgaccagtgtgcgcggtaaggtcattagcaccaccagcaccgcttgagtccagcgataaccgcccgggctgacatcatccagttcgttaatcaggttgaaggtggtaaaaagcggcagcaatagccctgcggcggcggcaaaaccgagaaagagatgacggattaaatagcgactgaaaacattcatcgggaaaatttctgcagcaaagtgaagtcgcgtgcaaccagcatcagcaggcccattagcatgagtccgggcactaaccacaaaccaggaatgagaggaatcgcgccgttagccaccagcgtacggcagacgtcgccgccataaaaaatggcaacaaacagcaacgtcagtggcaataacgttgaaaatcgcccttgccgcggttttacccgacttaatgaaatggccagcagcgccatcaacaatgcggtcaggccacggctttgtcgccattgcagttcggcatgatcggccggaaagacggagcgcgccagctccgtgaccgattttgctttgcgtttgacgttagggctttgatccagcggattcagatgtaattgcagattacggtagatctgttcgttgtcgtcacgcccctgatgatcgagaagataggcggtgccgttgtgcaacataacggtcggtttctcgggagatgggtcaaccacatcaaccgaacgggcgcggaaaatgcgggttcgattggcagtagaagtataaatcagcgcgtcagtcaggcgattattatcctgatcaaccgtctgcgaaaggatcattcgtccgttatctttagtgttaaatttctttgcccgcaactggcgaacatccagctccgactgcgactgctgctccagttgataaatctgcgcataagcccacggacgaccatacatcgacagaagggtgacaaaaatacttagcggtatcgccagataaagaacggctttgtacaagcgtcccggactgccccccgccgcagagatagcggtaatttccgagtcggtatacatctgccctagcgtcacgccaactgacacatacagaccaacaggtaacaacatctccagtgcaatcagcactttgtagaaaacgatatccagcacaacatcaagagctaatgtcccatttgccgcttcggtcagataacgctgtgaggagtagctggcgaaaataaagatcagaaaaccgacgataatcagcaccagacggcgcgtaccacgcatgatgtagtgttcaaccagcttcatctcactaacgccctcaatcctttgagttttttattcattgatcagtttctgcgccaacgcaatgacatgatctacctcttccggcgtcaggctgccgtcctttgcccactgaatttgcccggctttattcagcaccagaatggttgaactctgctccggcaagcgccaggcaacgcgtccctgtccattgccgtcaataacgaattgcgcccacggatagcggcgtttatttttttcgattttgccaacaacaaaatagccagtaccaaagatggcatcatcggtgttcacaatggtggtgggctgaaaacgatcctgcggaaagtttgccgcttcaaccgctttaattaacagtgagttctttttcttcgccgacttacgcccggcgatatactggataatgcggacttttcccgccaattgtgtgctgttccacttttggtagtgaatttcgtcgtcactattcagaagcagctcgccgccttcctggatataaacgggggtaaccgttttgccagtgacgaaattgtgtgcctgaacacccggggctaagagcatgataatcagcgcaataatcaaacgagatgacatcattgctccggttatagcggaaaacgcgaaatcagcagctctaagcgctggcgaatatcgctatccagcgccaccggtgcatcatacgactggcggttttccatatcatccgccaccatgtcgtcgtgtttatcccccatcaggccattaatggcggcgaggaaacgggaaatctgtaacgcctctttattttcaggatcaagcgatcttaaggtatcgtaataagaaacctgctggctgatgatttttcgcacatcatgaaattccctgccggttagtcgcggtttggcaattatctctttcagggcatgcatttgcttttgccgataggcaataaaaccgcttacgctttctaactggctatggcgtaatgaatagttcaccaacgaccagaccggagagcttaaataaatccgcaacaggttgccgtaatatgacacaatatttttcttaccgttacgaaatccgtcctgaaaacgtcccagaaaaacggtcgttttgccgaataaaaatccggcctgatgcttctttaaatacagccgttgcgcaaaacgcaggtgcttgtagcgcgctcgcatgtatttaaattgtttgcgctcatcagcagtcagctcatcgcctttggcttgtttgcgaactaaacgcagtaattcctgacgatcaacgccattgagccagaattgcaggcataacgcgtaattatcatgaatgatttcggtggtacaacttagtgcaatagtcggcggcaaactgacctgtgcatcaacgacatcatcttcttcaatcgcaacaaatagacgctcgctcgcctcaagcgggaaatattttctcatcatcaggatttctctccggctgcgttataaagcaatgaatgacgctgaaaaaaagcctttaaggttggaattaacgagagcaccacatccagacattgcccaccgaagtaagcaaatgcagcccccagcacgccaaacagatgacagaacatgaacagcaatacgatgtagccgattgaggcgatggtttgcgccacgagaaaagcgcgctgttttcccgccatcaatagcaatgactcctgcgggaagcccagcatcgagatcacaattgcgcccagcatcacctgaatcaggtcatacgcttcgagatacttaacgccaaacaccagcgaaattagcggcttgccgacgatcaacaccgcgagcgccaccagaataccgattccgccctccagtaaaccggacttcacgcctaacaaccacggtctggtggtgcgcggatctaaacgcatcacctctgggtaaaaacttttacccagtaaacccgctggcgttccggcggcgtcgaagaatgtcatggcgattttaaataacccggcggcagcgggtcctaacacgatccccaccaacactgtgctgcacgagttacgcgccgaccagatggagtgggcaatgttggttgaccagacaaaactccacgcgcctttaatgtgtcgggcagactcaaacagattcaatttgaaggcgttatggatatttctgcggcgtaattcgcgcgcggcaaaccaccagtacatggtgccgccaaccagattcgacacgtaccaggcaataacaaaacccgcaaaaccaaagtcaaaataccaggctgcgacgctccccgctgcgcgcagaaaaggtttcgtcgcctgctgtacagcaatcaaatcaaagcgatctaccgcacgcagaatgccggtcggcgtggaggaagccattgaaggaatgagcgtgcaatacagcgccgccagccaaaagctttggtcatccagacctaatgaatgggaaaggaatggcagtaaggcaatgccgccgacaatcgccaccgcgccgctgacgatatccagcgagaaggaaaatgagacgacattgcgaaattgctgcggattattgttggtcaaggctggcgttccgtactgaaccaccaactgccatgtctgaaacttaataaaatcgctgatcgacttggcgtacgattgcacaatcaccagtacgccaaacatggcgggcgtcatccctttaccggcacacgagagcgccaacagccccagcaaggcgctcacgacattactggagcctaaccaggcgctattgcgaataatggtgcgaaacgcgccatctgcaaaccaatgtttgatgttaaaacccgccaattcagcctgaccttatcgttgatagtaaaaagtatcccgccagccttaagttaaacttcggcggtcagaaacgatggcaaccagagaaaccgccttctgtgcctgttccagcacttcgctgtagggcgctctggaatcaatctcaagaatttttgtgccgttatagccaatcgtcgacataacaccgattttgtcctgcagctcggcatagtcatggtcaggcttgcgggagatggcagtctcaatatcaatccccaaacgaatgattaattcaggacggtattgcgccatttgttggtataaacaccgttcgcgctgcgccagaaacatgctgattttcccggtcgcacgttcgacgccaatccccggtccgtcataataaaagcccgaaatttcagcctgcgggaagcgatcgctgaccaccagaacgccactttgcgccagtcgctgaaccttgcgtagattcgccattcttcgcagcgagaagcagtacataatcaccgccgcccatagcgctggagatttggttttcatgctttgggttttcgaggatttggccgccaatcgccgttccagccagacgccaaccaacggcaatcgtttgattttgtcgccgtcttcgccggagagcagccccagatagcgccgctcggtttgccagtgttgttgcagcgatttcaccaggtcggtggtcagtgtggatttaccggtgccatcacacccgaccaccgcaatcagccccggaatgtagttgggctgcggcgcggttgtactaataacagtttgtgtttgtagtgcatccattcgttaaatcatcccctatccattttggtgatcaggaaagcgcggcgtgaattgcgcgtagtgacgcttgcagaatttcatcggctggttgccgaccatccagttcaaggatctttgcgccattgaatgtcaattgcggcgtaacggcgattttttcctgtaacgctgccagttggtggtcaggtttacgcgcaaacgcggtttgttcatcaatgccaagacgaatcaacaatatgggcaaataagacgccatccattggtacagcttcaactcgcgctgccttaacatttttatccaaccgttaccgcccgtggtttttgccaattgcgggccatcaaagcgaaaccccggcacttcaacctgcgggtagcggtcggtgatgagcagaaagccttgctggcttttacacaacattttgcgaaacttgtacgcccgccagcaggaaagcagatagataaccagtgcagtaatattgccaggcggtgttgagggcttttcgtgcacatgtgccgctttacttcgcagataacgcccaaaaggtgcgccaataacagggagctgtgaaatccattcgccaattcgcccggacgattgcccgagataaatgtgttctgttggcattcttgctgccagttcatttaccaggcttgccgtgagggtcgatttacctgaaccatcacatcctacaatggcaataacatgcactggcgtggaattaattattgacatattacgttgattcacgaaaaacccggcagtaaataatgtattgaatattacgtggtccgtgctcagaatatccgttcaaccttattgtgacaatggttaattgtgacattgacctgaattacgctttcataaaaacatattaaccaaataaatatttttaatggatatttaaattaaaggatatattcatgcagtcaataacacctccattaattgccgttattggtagcgatggttcaggcaagtcaacggtgtgtgaacatcttattaccgttgtcgaaaaatatggtgctgccgaaagagttcatttaggaaaacaggccggaaatgtcggtcgtgcagtgacaaaattaccgttgatgggaaaatccttacataaaacaattgaacgaaatcaggtgaaaacagcaaaaaaattgcctggaccagttccggcgctggtaattacagcgtttgtcgcccgtcgcttactgcgctttcgtcatatgcttgcctgtcgtcgtcgcgggttaattgttctaaccgaccgttatcctcaggaccaaattcctggcgcttacgatggtacggtgttcccacctaacgttgaaggtggtcgttttgtctcatggctggcaagccaggaacgtaaagcgtttcactggatggcgagccataagcctgatctggtcatcaaactcaatgttgaccttgaagttgcctgtgcacgtaaacccgaccataaacgggaatcgctggcgaggaagattgccataacgccacagttaacctttggtggtgcacaactggttgatatcgatgccaatcagccactggaacaggtgttggttgatgtagaaaaagcgattacggattttatgaccgcgcgtggttatcactagtcaaaaatggaaatgcccgatcgccaggaccgggcattttcaggaaggttaaatcaactgcaatgctatccagtacagcccaccagaaagaaaaattgccgccggtaaagtaaacacccacgccatcaggatgctggttaccgttttacgctgtaacccaccgccgtccaccaccatcgtccctgctaccgcagacgagaggacgtgtgttgtggagacaggcatcccaatataactggcaaggccgatagacactgccgccgtcatttgtgccgccatgccttgcgcatacgtcatgccgcgcttaccaatcttctcaccgatggtcatcgctacacgacgccagccaatcatggtgccaatgccgagcgccagtgctaccgccatgatgatccacaccggagcgtactcaatggtgcttaacatatcgctgcgcagttttttcagcaggttctggtcttctttactgacgcctggcagtttcgccagcttcgcggaggtatcagagatgcacagcataatgcggcgcagctggctgcgctgactcacggttaacggctcgtaactttccatattgcctggcagcatcgttttaacgcgcgcaatagcatcaaaggtatttgccggatgacagtgaaactctgttacttgcgtgccatcagtcgatgctgcaggcaatggaggttccatcgcaatcaacttctgcggcagttcaggatgctgttgcaggtagtgttcgaagttggtaacggcatcgcgggtacgggtaatttcatagccggacgcattcatattgacgacgaagccagcaggggcaatccccaccagtaccagcattaccaggccgatccctttttgtccgtcgttcgcgccgtgcgaaaacgccacgcccgcagcggaaacaatcagcgcaatacgcgtccagaatggcggtttacgtttgccttttttctttttgcgatcttccggaatgcggtgaatacggtcacgctttttcgtcccgctccagtagcgtcgcagcaggaatatcaggcctcccgcaatgaccaggccgacgataggggaaacaatcagcgaggagaaaattttggtcacttcacgcaggtttaacgcatccatcaccgatgagccggttaacagcgcgttggttaaaccgatgccgataatcgcaccaatcaaggtgtgcgaactggaggccggtaaaccgaagaaccacgttcccaggttccagataatcgccgccagcagcatggaaaagaccatcgccaggccgtgggttgaccccatattcagcaacaaatcggttggcaacatatggacaatggcataggcaacgctaagtccgcccaataacacgccaaaaaagttaaaaaatgccgccatcaccacagcaagttgtggttgcatggcacgagtataaataacggttgccaccgcattcgccgtgtcatgaaaaccattgattgcttcgtagaacaacacaaatgccagagcaagcaataacaaaagccctgtgtatatatcaaggccaacaaataaatttagcatatattagattacgccattttgaatttacgaacggacgcattatcagtgactttaacggcatgggcaaagtgaaatatcattttttaacgataaaaagagtgttatttcttgtgtatcagacaataagcattcattcaaaacctttagaaataatcaaagcacaggtattccactggttaatatattcacatatgaaatgaataaatattgaaatatataaatattgaatattttgattaatccccgtactaattattcttcataatcagtacggggttgctacaacatgtattactttttcaccacaattaacggttcaatatcactctcttttttgatgaccagtgattcatcaccgcgcaaacacgtcccaccgtagttgccgccaacggtgaaggtacatacctgaatgtatttatcgtccactttcggcaaacaccacagttgctgatagatgtttttctgctcggcaaatttaccgctggttttgtccagcacctcttcatgatggctgaccaggtcgatattgctaccacagcgaccggcgatcggtttcactgcgtaacctgttttcaccagttcatcattaacagtgaaatcggtatccagcaggtaacgatggtgcggaaacagcgaccagaggatcggcagaatcgctttgttgccggggatcaccgtccacagcggctcaaagaccagcacttccgggcgcagcaatacgtcgataagacgcacttcgttttgcggatgaccggtacggattggcaccgcagcaaactcacggtcgctaacttcacgaatctgatcaaacgcggtttcccacgcccaggttttccacacgcagttaaccagtcgcccttccccatcaatcagttgcccggcagcatcccagcccagttcatccaatccacgcaagatacgcgtttcaaagcccgcctggtgcagcgcctgctccataaactgcgcgtgatagttttcctcgatatctttgtcctgcatgatatggacaaacggacgtgcacgactgtgtttccaggcaccagccaattcgttaatcagcccttccgccggattgaagccgttgcctttatagccctgctccgcccaacgttcgaggatcaagcccgcttcggtatgacaggaggcggagtcggcgttgtactcgtaaaccttcaggccacgctcatccatgcagaaatccatacgaccagtgatcatatggtgacggcgacgctgccaggagagacgcaaacgtggccagaggattttcgggatgtcgaacagcgccagcaggttgtcatctttcagcaccttgtcggttgcgtgaagatacatcaggtgcagctcgttggtggctttaattagctcctgctcggcactctcggtaatggtgtagtaatgataaggatcctgattgatcacctgaccgttggcctgcacataggcgttttgcagcggatctttttcatccagccatttaccgtcaaactggcctttgttttccaggcgcgctccgctgattttcagcagctcgcctgcaatttccggctgcggtaagctgtattcagtatcttccgtctggatcatccagcccagaatggtggtgtcatcaaaagtgtctttcagggtatagcagccgttttcgaccaccatctccagctcacgcgtccactgttgcccttgcggcaacggggaatgaatcacgttctgttccgcaatacggactttgttgccatgcaattgggtaatgatggcgacatggccagtgtctttaaattcaccgcctttatcccagataagaagcgcacccgcgaccggcgcacgcggcgagccgttaggaaatgcctgcaatggcaggatgttgtcattaaccacttctcgcaggaagcgcagcgagaaaatctcccacgccatacccacgtcagtaaagaccacaccgtaattcagaaagagaaaacggcgagcaaattcaacgcattgccacttgtggcccatatattcgtcgtcgatatagctacggaatacggcgtcatcttcgtattcctgcggatcgagagaactgtaatctgaagagtagattgctaccccacctggggcgtagcccaataatgtcccgaacggggcatcctggctggtcgttcctttgctcatcactttacctttaacaatacaacctaagcagttggcgtaattgttgtgctctgattacctgctcagcgacattaaccggacagaggtcagactaatcatacacctcatcgcagcggctggcgcaaagggttaaaaaattcacattctgtacagcaagtgacctgctacactgcttcaacactaccactcagaaggcaactcactatgacagacaatacttatcagcccgcgaaagtctggacgtgggataaatccgctggcggcgcgttcgccaatatcaatcgcccggtttctggtccgacgcatgaaaaaacgctgcccgttggcaaacacccattgcaactttattcgctgggaacgccgaacggtcagaaagtaacgattatgcttgaggagctgctggcgctgggcgttactggtgcagagtacgacgcctggctgattcgtattggcgatggcgatcaattctccagcggctttgtcgaagtgaacccaaactcgaagatcccggcgctgcgcgatcatacgcataatccgccgatccgcgtgtttgaatctggttcgatcctgctttatctggcggagaaatttggctacttcctgccgcaggatttggcaaagcgtactgaaacgatgaactggctgttctggttacagggcgcggcaccgttcctcggcggtggttttggtcacttttaccattacgcaccggtaaagattgagtacgccatcaaccgctttaccatggaagccaaacgtctgctcgacgtgctggataagcaactggcgcagcataagtttgttgcgggcgatgagtacaccattgcggatatggcgatttggccgtggtttggcaacgtggtgttaggtggtgtgtatgatgccgctgagtttcttgatgcgggcagttataagcatgtacaacgctgggcgaaagaagtaggcgaacgtccggcggtgaaacgtgggcgtattgttaaccgcaccaacggaccgctgaatgagcagttgcatgagcgccatgacgccagtgatttcgagacgaatacggaagataagcgtcaggggtaagggttggtgttcgtcgcagcaagccatccaggccggataaggcgttcacgccgcatccggcaatcgtgcacaatgcctgatgcgacgctgccgcgtcttatcaggcctacgaaagctaatcatcacgcgctggtaatgtcgtaatccatttggcgcagtgcgtctaatgtggctttggcttcatcttcgtcgatgatgctcatggcaaatccgacgtgtaccagcacccactggcccagtagagcggcagggttaccttcacaaatcagggcgatattcacatcgcgcttgataccacatacttcaacctgcgcaagctggtgaatatcttcaccgacagccagcacctggcctggaacgccaatacacattattaactccggttattcaacttcaatacttttgacgatcagcgaatcgccggtatcgacacgcaaccgctcgccgtgacagagcggacactgcgcatcgtgctgatgaatctccaccacctggctgcaatcccagcaccaagcctgggcgggtttatagacgatatgtaaatcgcacccttgcgccaccgttccgtggcagacaatttcaaaactaaaacggacggcgctctcctcaacgcaggagagcgcgccaatttccagccacacggcggtgacgcgcttaacatcgtgctgctccgcctgccgttggataatttcaacggcgctctggcaaagagacaactcatgcattttcgccactcctgcgaccaaacagcagggcgcgacgccctgcgtgtggtacatccggattcgtgactggcagcgaaaggatcattcgtgcgcagtcatccgtcaggcgttggccctcttcaatcgacatgctgtgcaaaagcggcgacatcagcgaacaggagagatattgcgaaacaccgtccagttcgccaacggtaaaggtcatagtgccatacggcagttgcagaccaattttttcactcactttgcgcagcggccagagttgatccgggccggggaagataactgcactcagcatccacggggtgatcacacaccccgtccactgaccttcgaacagcgtaaaatcagaaacatacaccggcattgaaggatgcagaaaagagagatcgtgcatcgaacgccgggcaatttcttcaaacgctgcctgtacttgcgccttcggggaggtctggaaacctgctatctcttcagtcatgaatcgcctcccgtgggatggcttccacgccagattcacgcagcgcagccagaacctgctcaagcgcaggttcaatcattgcttcaaccgtcggcgttaagccgatgtgtggctccagcgattccgggatcacgccgaccagggtcagctttttcggaaactcgccggtgaagcgcagggccgacaagacgtcggccaggccaagctgatgcggagagattttgttggtaaacaacgccggaacttcttcatcccgcaggatcatcatcgttcccggcgcgttctttttcgagacaatggcatccgcaataatcaaatgatcgcgatttgccatgtcgccaagcagctccattcccgccgtgccgccatcgaggatctcaacataatccggcagaatgtatcgttgctctaacgcttcgacaatccgcacaccgatggcttcatcggtcagcaaaatattgccgacccctaagactaaaatacgcattacagaaccttcactgaaaccacttcgttgccgtcagcatccactacgtgtaccgcacaggccatgcacgggtcaaaggagtgaatggtacgcaccacttccagcggtttattcggatcggcaaccggtgtacccaccagcgactgctcgtaaggaccgacgtcatcattgaagttacgcggaccagagttccaggttgatggaacaaccgcctggtagttgctgatgataccgtctttaataaccatccagtgagagagcataccgcgcggcgcttcgaggaagccaacacctttgaattcacccgttgccggaatgttcggcttcacaaaggtggtgtgatcgcctttgccgatattggtgatcagtgcactgtattggttttgcaggatatcctgcaattcacagcagtgaacggtacgaccaataatacggcccagcgtggagtgcagctgtgccacttccagcgtgttgccagtcagtttctgataaatcgcaacgatttcattcagtttgttctgggtagattcgcgacctgccgccagtttcaccagcatattagccagtggccccacttctaccgttttgccgtagaaagtcggtgatttcacccaggaatatttcccgtcgtcagaccaaccatcataagccggaatggtggtgccttcccacggtgcctgcggcgcttcgtctttataccaggagtgcttcgcgctttcctgaatgcctttgatcaggtattcatcggaatgagaagtgatcggacgatacgaggacagatccgcattctcaatgtagccgcccgggaacaggaagctgccgtttttactgtcggtcgggaattccggcacgctcaggtagttcaccgcacctttaccgcgtgtcagccattccgggtagaacgcggcaataactgcggtatcaaccttataaacctgctcaacaaagtcgctcagtttgtcgatgaaagacttgatgtacatcaggcgctcaaggttcagcacgcccaaaccgtcgaggttgatcgggttcgcgacaccacctaccgccaggttctgaatgtgcggcgttttaccgcccagcagcgccacgacgcggttagcgtcacgctggcactccaacgcttgcaggtagtgcgctaccgcaatcaggttcacttccggcggcagtttcatcgccggatgaccccagtagccattagcgaaaatacccaactgaccgctggcaaccagatctttgatcttgttctgaactttggtgaactcttccggactgttcaggtgccaggtcgaaacgcctttcagcatttcggaggctttggttgggtcagcttgcagtgcagaagtgatgtccacccagtccagcgccgaaagctgatagaaatgaacaatatggtcatgcgtggtgtgcgcagccagaatgatgttacggatgtattgcgcgttaaccggaacgtcgatattcagcgcactttctgccgcacgaacggaagacagcgcgtgagtggtagtacatacgccacagatacgttgcacaatcatccatgcatcgcgcggatcgcggtttttcacgatctcttccatgccgcgccacatggtaccggaagcccatgctttcgaaacgacgccattttcgatttcgcaatcgatgcgtaaatgcccctcaatacgggttaccggatcaatagtaattctctggctcatgctttgctcgcctcatgacgattatgatcgttttgttttaaaggaggaagtatcggcagtagacgaatgagtacgatgtaagcgcaaatctcaatagccacaaaaccaatagaaatcaacagttcttcccaggtcgggaagtaggcgtaaccgccgcccgggttgaatgccaccagcgaataggtcagacgccaggttgcacaacctaacagtgcgctcagtgctgacaggaacagcatgcgggaatcattacgcagcttcgccacacgcagaacgaccagcgggaagagcatcagcaggacttcaatccagaacatcacggagtagaagtcaccggcaaacgctaacgacagcttgtcgcgatagataagctcgccaaagcgcagcacgatgaaaatcgccagcaacacactgatggtgttggtcagcttaacaaacagactcttttcatccggaccgttgccacgcagacccgcctgcaccagcgaaccttcaaagatgacaatcgagaagcccatgatgaacgccgtcagcagcgagaacagcggcaacatttcatagctctgccacaacggatgcaccttgtagcccgccgagatcatcagcgaccccattgaagactggtgcatggtcggcagcagcgcaccgagcgcgatgatgaagaacatcaccttgtttagtcgctgtagcgacaccttccaccccagacgttcaaacagtgccggagcaaactccagtgccatcacgccgatatagatggtcatacagaccgccgtctcgaacagtaccgagttcacgttgaagtgacccggaatgtagaagtacggcaggttccagtagcgacccacgtcgatagtgatcgacaagccacccagtgagtaaccaaacagactcgccaacagcgccggacgcaccagcggatggtattgcccacggttaaagacgtataccgcccacgccagcgcccagccgccacaggcaaagccggtgccaatcagcaggtcaaacgcgatccacacgccccacgggaagccgccgttcaggtcagagacagagcccagaccgaacaccagacgcttcacaatcaggagcatacagatgacgattaacggtccaaaaatcatgaccggtttactgatgattttgccgcccagcggttgtggatcatgactcatgatcgtctcctccgtcgtgatggtcgtttttggtgttgcgacgaaccagcacggttaagcccgccagcacagccagtggtagcatcatgcctttatacagggtgtgttgaatattttcggaacgcgcaccggtagaaagatcgtccagtttcggcaggtcgagattttcataaggcacacccgtcagtaccagaacctgagtaccgccgccctctttctcgccgtacagatgcggataatatttcggcaccgtatgcaggtaagtgtcgccagatttcagcgtctgacgcggatagtggtattcgctgccaggcttcagcgccagacgttttttcgcctccgccatcagctcttcacgcgtaccgaaaatcaccgcgcccgccgggcacacttctacgcagccaggtagaccgcctttatcgagacgttccacacctttctggttgcacagctcgcacttatgcagcgcaccaaacgggttgttgtagtcgtacttcggcacgttgtacggacaggcgaccatgcagtaacggcagccggtgcacacgtctttgtcgtaatggacaatgccggttttcggatcttttttcagtgcagagaccgggcacacagagacacagttcggatcgacgcagtgcatacactgtttcttaatgtacgcgtagccgttctcctcctggtctttgttgacccctgtgccgctggtccacacctgaatgatgttattggtatacggcgacagtttgtcgttgttcgaccagatctgttccccttgcgggttacgttcagggaaattgatatcctgacacttggtgacgcaagcctggcagcctacgcacaaggtcgagtcgtacaacatccccagcgatcccggaattggcgggcggttttcagcagccgcatgactgacagacggcagcgcgcccgtcagcaatgccccgcaggaggctgctttaataaaattacgtctgttcacggttattctccccgtgagtcagcgttatctttcttttgctgacgacccagttcacgcaccgccatcacgctgacaccggcaaccaacccaaccacaccgccgagcaaaccaatagcgcctgcagagacgttgccgccctctttagcgttaacatccggtttctgtgaacgcggagtttgattttcgacgttggcaagctgatggatgcctttatggaagccgataccttcttcgttacagccatagcacgggtgaccaatcgccaccggccacacaccgccaacatcgcagaattgcagcgttgagcagttgccgtaagtttctggccctttacagccgaggtggtacaggcaccagccttcgcggtggccttcatcaccgaactctttggcaaaacgaccagcatcgaagtgcgggcgacgttcgcagtgttcgtgaatcagacggccataggcgaaggtcggacggtttttgtcatccagtttcggcggtttgccgtaagtgatgatgtgcgcaacggtcgcgaggaagttgtgcgggttcggcgggcagcccggaatattgataacggttttgcctggcagaacttcttgcaggctgactgcgccagttgggttaactccagctgcggcaacaccgccccacgcagagcaggaaccgatagcgataatggctgctgcgccttccgccgctttgcggatgtgatccacaatcggctcaccggcaaccatgcaataaataccgttatcttttaatgggatggaaccatccaccactaacacatactgccctttgtacttctcgagagcgttatgtttgttctcttcgacctgatgaccgaaggcggcggaaagcacttcgtgatactccagagagatagtctccagtacgaggttttctaccgttggatgcgttgcacgaagcagagattccgtacaaccggtgcactcctgcgcgccaatccagataactggcggacgctgcgggttagtaaccgattcggccatctctgcagcggctttgctacttaaccccatggtggcggctaatgctgcacaaagcttcatgaaatcacgacggttaatgccgtgagaatggatgagggtgttatctccagtcatttatagttattccgttgcgaagacctggcatatattttgcctcaatcgcaaaatcaataatgcgatcgatgcgccatttaccacacatttattatggttatcgatatcatgatactgcggcggggcgctaaaacgaagggaagaagcattagtgtaattaattaaagcaagataatacgtatgtttgatcaattttcgaggcgataaccggccataaaaaagcgcaacgtagaacaggaattattctcacgaaagaaatccattaccatctctttatccagtccatagcggcgcgtcagaatacccgcttcccaggcgctaagctggcgatctccggtcttttcgtacatccggtgtgagtagcctaatacaaaaccgcgtttataatcggcacagaattttgtcacattaaccgcactgtcggcatgcgttgcttttaatcccgccattaagcctttaccaaaatggttattcatcgttcacctcattcgctatatattgtaatatatagcgatattttaggcaaagaacgacttttgcgcacgctattttttcatgcttgtttaagacgtaatcccgtaagagataaacctatcaggagagatatttatcgaaccatttcagtgtcctttgccaggcaagatcggcggcagatttgtcataacggggcgtggaatcattatggaatccgtgattaacccccggatagatatacgcctcataaaccttattattggctttcaacgccgcctcgtaagcaggccagccctcgttgattcgggtgtccagttccgcgaagtggagtagtaaaggcgcttcaatcttcgccacatcggcagtgggtgcctgacgaccataaaacggcaccgcgcaggccagttccggatacgcgacagccgccgcgttcgatacgccaccgccatagcaaaatccggtaatacccactttgcctgtcgcttgcggatagcgttgcataaactcaattgcggcaaagaaatcattcatcagtttggttggatcaacctgctgttgcagctcacgacctttatcatcatttcccggataacctccaacggaacttaagccgtcaggtgccagggcgatataccccgccttcgccactcgccgtgccacatcttcgatatacggattcagtccacgattctcatgcaccaccactacggctggcgttttgccgctcatctttgcgggcttcaccagataaccccgcacctcgccgtgaccatttggcgaaggatacgtgatgtactcagcaacaatttccgggtcggtaaactctacctgagtcgccagcgcataatttggcttgagcaaatcaaacaacgctaatgccgtcatcccgcctaccgcacttcgccgcaaggttgaggaactcacgtttcgagattttcccgtgagcgtaatagtcatagtaatccagcaactcttgtgggaaatctttggcggttaaacgcggcatcgttgcactcctcagttggtgtttttttaagcaaagcataagcacgtgtttttgcccagtttttcgtcactctgtgagccagactacgggatacgcgctggcgaatcgctaaactagaaacattgtttcgaaattgaacggtggaaaggagaggtcatggtctggttagcgaatcccgaacgttacgggcagatgcaataccgctattgcggaaaaagtggtttacgcctgcccgcgttatcgctcggtttatggcacaatttcggtcacgttaacgcgctggaatcacagcgtgcgatcctgcgtaaagcgtttgatttgggcattacgcactttgatttagccaacaattacgggccgcctccaggaagcgcagaagagaactttggtcgcctgctgcgggaggattttgccgcttatcgcgatgaactgattatctctaccaaggctggctacgatatgtggcccggcccttacggctctggcggttcacgtaaatacctgctcgccagcctcgaccaaagcctgaagcgtatggggcttgagtatgtcgatatcttttactctcatcgcgtcgatgaaaatacgccgatggaagaaaccgcctctgcgctggctcatgcggtacaaagcggtaaggcgctgtatgtcgggatctcctcttactcgccagagcggacgcaaaaaatggtcgagttgctgcgcgagtggaaaattccgctgttaattcatcaaccttcgtacaatttactgaaccgctgggtggataaaagcggcctgctggataccctgcaaaataacggcgtgggctgtattgcctttactcctctggctcagggattgctgaccggaaaatatctcaacggcattccgcaagattcacggatgcatcgtgaagggaataaagttcgtggtctgacaccgaaaatgcttaccgaagccaacctcaacagcctgcgcttattgaatgaaatggcacagcagcgtggacaatcaatggcgcaaatggcgttaagctggttgctgaaagatgatcgcgtgacgtcggtattgattggtgccagccgcgcggagcaactagaggagaacgtgcaggcgctgaataatctgacatttagcaccaaggagctggcgcagattgatcagcatatcgccgatggcgagctgaatctgtggcaggcgtcttccgataaatgacctgttaataacgggcgcgcgaaccgcgcccgaatcagatcagtgattatgacgagtcagtcggtcaagatagcccatcacaaatgcagaaagcacaaacgtcagatggataatgacgtaccacatcagtttgttatccgggacatttttcgcatccataaagacgcgcagtaagtgaatggaagaaattgccacaatcgacgctgctactttgtttttcagcgacgttgcgtccattttccccagccagttcagcttctctttgttctcggagatatccagctgtgagacgaaattctcataaccggaaaacatcaccatcaccagcaaaccgccaaccagcgtcatatccaccagcgacagcaacacgaggatcaaatctgattccgccatcgagaagatattcggcagtacgtgaataatctcctggaagaacttcagcgccagggcaactaacgccagcgaaaggccaaagtacacgggggcaagcagccagcgagaagcatacattgcattttcaagaaaacgttccatacattcctgtcgtgtagttaaaacgggcaacagtatatcgcaattgagtaaacagcacgcaacagcaaatcaacatatacgttaaacctttgtcgcataattctgaggtttagggatcttcctggttcccttatcaacgcatcgagaacgtctacccttaaaggacgttgaacctgaagggagaaaaacgatgtctcatttaaaagacccgaccacgcagtattacactggtgaatatcccaaacagaaacaaccgacgccaggcatccaggcgaagatgacaccggtaccggattgcggcgagaaaacctatgttggtagcggtcgcctgaaagatcgtaaagcactggtgacagggggcgattccggaataggtcgcgctgccgccatcgcttacgcgcgtgaaggggctgacgtggcgatcagttatcttcccgtggaagaagaagacgctcaggatgtgaaaaagatcattgaagaatgcggacgcaaagccgttctgctgccaggcgatttaagcgatgagaaatttgcccgttcgctggttcacgaagcgcacaaggcgttaggcgggctggatattatggcgctggtcgccgggaaacaggttgccattccggatattgcagacctcaccagcgaacagtttcaaaagacctttgccattaacgttttcgcgctgttctggctaacccaggaagcgatccccctgctaccgaaaggtgcaagtatcatcaccacttcgtcaatccaggcataccagccaagtccgcatttactggactatgcggctacgaaggcggcgattctgaactacagccgtggcttggcaaaacaggtcgcggagaaaggtattcgggtgaatattgtcgcgccaggcccgatctggacagcactgcaaatttccggcggacaaacgcaggataagatcccgcagtttggtcagcaaacgccgatgaaacgtgcggggcaaccggcggaactggcccctgtatatgtttatctggcaagtcaggagtcgagctacgtcaccgcagaagtgcacggcgtgtgcggcggcgagcatttaggttaaaaaaatgcccggttgtgaaaagcaaccgggcatcattgtgaattcactcttacctgatgtggcgaaaacgccttatccgcctacaaacgcatgaagattcaacatgttgcaatagattttgtaggcctgataagcgtagcgcatcaggcattgagcacctaatgccggatgcgtcgtgaacgccttatccggcctacaaacgcacgaagattcaacatgttgcaatagattttgtaggcctgatgagcgtagcgcatcaggcaattctactttacttcgctttggcggtttcttcgccgaccagacctatcttcaggtaacccgcctgatgcagcgtatccattaccttcatcaacgtctcgtaatcgacggttttgtccgctcggaagaagatggtggtgtctttcttgccttcggttaacgcattcaacgccgtaatcattgtttcatcggtgaccggatcgttaccgataaacatcgagttgtctgccttcaccgacagataaaccggtttttccgggcgcggctgcggcgtgctggtagaagcaggcaagttcaccttcacatctaccgtcgctaacggtgccgccaccataaagataatcagcagaaccaacatcacgtcgataaacggcgtcacgttgatatcatgcatttcgccgttatcgtcgaggttttcgttaagatgcattgccatcggatattatcctgcgcgtaatttttgtgcgacacgaaccggatgcgcagcggcgctggcttccagatccaggtcacggctttgcagcaacaatacctgcgctgcaacatcacccagcatcgctttaaagccgccaatctggcgtgcaaatacgttatagataacgaccgcaggaatcgctgccacgaggccgattgccgttgctaacagagcttctgcgatacccggcgcaacgactgccaggttagcggtctgcgtttgcgcgataccaataaagctgttcatgatgccccagaccgtaccaaacagaccaacgaacggagaaatcgcgccgatggttgccagatagccgttaccgcggcccatttgacgacccactgcggcgacccgacgctccagacggaagctggtacgttctttaataccttcgttatcgtcgctgccttctgacagttccagctcattctgcgcttcattgagcaaatgcaggcttaagcttttgctaccaaaatcagcggcgatatcgttggcctggtttaaggaacgcgcttcagccagcagttgctgctcgcgcttaaggcgacgcttctgattgaagaattctacgctcttactgaagaagattgcccaagtgactacggaggccaaaataagcccaatcatcacgcacttaacgacaatatcggcgtgctgatacataccccagacggaaaggtccgtctgcatcaaattattacccactgtgtatctccaggacgcaagtcacaaaatctgcgcataataatatcaaaatgacgtcgaattgatagtcgttctcattactatttgcatactgccgtacctttgctttcttttccttgcgtttacgcagtaaaaaagtcaccagcacgccatttgcgaaaattttctgctttatgccaattcttcaggatgcgcccgcgaatattcatgctagtttagacatccagacgtataaaaacaggaatcccgacatggcggacaaaaagcttgatactcaactggtgaatgcaggacgcagcaaaaaatacactctcggcgcggtaaatagcgtgattcagcgcgcttcttcgctggtctttgacagtgtggaagccaaaaagcacgcgacgcgcaatcgcgccaatggcgagttgttctatggacggcgcggaacgttaacccatttctccttacaacaagcgatgtgtgaactggaaggtggcgcaggctgcgcgctatttccctgcggggcggcagcggttgctaattccattcttgcttttgtcgaacagggcgatcatgtgttgatgaccaacaccgcctatgaaccgagtcaggatttctgtagcaaaatcctcagcaaactgggcgtaacgacatcgtggtttgatccgctgattggtgccgatatcgttaagcatctgcagccaaacactaaaatcgtgtttctggaatcgccaggctccatcaccatggaagtccacgacgttccggcgattgttgccgccgtacgcagtgtggtgccggatgccatcattatgatcgacaacacctgggcagccggtgtgctgtttaaggcgctggattttggcatcgatgtttctattcaagccgccaccaaatatctggttgggcattcagatgcgatgattggcactgccgtgtgcaatgcccgttgctgggagcagctacgggaaaacgcctatctgatgggccagatggtcgatgccgataccgcctatataaccagccgtggcctgcgcacattaggtgtgcgtttgcgtcaacatcatgaaagcagtctgaaagtggctgaatggctggcagaacatccgcaagtagcgcgagttaaccaccctgctctgcctggcagtaaaggacacgaattctggaaacgagactttacaggtagcagcgggctattttcctttgtgcttaagaaaaaactcagtaatgaagagctggcgaactatctggataacttcagtttattcagcatggcctactcgtggggcgggtatgaatcgttgatcctggcgaatcaaccagaacatatcgccgccattcgcccacaaggcgagatcgattttagcgggaccttgattcgcctgcatattggtctggaagatgtcgacgatctgattgccgatctggacgccggttttgcgcgaattgtataacattgccacttttggacaattttgcagacatttaattgtgaaaagtcttaaattgttgcgtccgggatcaaggcgtcccggacgaatcaggagtacaataggcagataaaggcttaaacgctgttccacaggaaagtccatggctgttattcaagatatcatcgctgcgctctggcaacacgactttgccgcgctggcggatcctcatattgttagcgttgtttactttgtcatgtttgccacgctgtttttagaaaacggcctgctgcccgcctcatttttgccaggcgacagcttgttgatactggcaggcgcattgattgcccagggggttatggattttctgcctacgattgcgattctgaccgccgcagcaagtctgggctgctggctaagttatattcaggggcgctggttagggaataccaaaacggtgaaaggctggctggcacagcttcctgctaaatatcaccagcgcgccacctgcatgtttgaccgccacggtctgctggcgctgctggctggacgttttcttgcatttgtccgtacgctgctgccaaccatggcgggaatttccggtctgccaaaccgccgcttccagtttttcaactggttaagtggattgctgtgggtcagcgtggtaaccagttttggctatgccttaagtatgattccgttcgttaaacgccatgaagatcaggtaatgacgttcctgatgatcctgccaattgccttgttaaccgctggcttgttaggcacgctgtttgtggtgattaaaaaaaaatactgtaacgcctgacgattttccccgttcccggctgctgtaccgggaacgtatttaattcccctgcatcgcccgcattcttgccgcatcttcccccggcgtcacaccgaagtaacgtttaaactcacggctaaattgcgatgcgctttcatagccgacgcgcatcgctgctgcgctggccttcatgccgtcatggatgatcatcatccgcgccttatgcagacggtaattcttcaaatactgcaacggcgaggtgctggtgacagacttaaaattatggtggaacgccgatacgctcatgttggcttctgccgccagttgctcgacgctcaggttttcggtgtatttattctcaatccgtttcagcacgcggctaatcagactgaagtgagtctggcgactgaccagcgccagtaacgcgccgccgcaaggtccggtcagcacgtagtacagaatttcgcggatgatctgtttgccgagaatacgcgcatccagtggtcgctccatcacgtcgagtaaccgctccgccgcgcataaaatctcttctgataacgtggcggagttaatcccgctggctgccatcgacggctggaaatgctcatcttcgccaatgtccatcaacagttcctgtaactgcaaaatatcgacattgagacgcaaccctgccagcggcacctctgacgtggcataggtttcgcactcaaacggcaacggcaccgtcagcagcaggtattcattggcatcataacgaaacacgcgttcattgatataaccgattttatgcccggaaaagagaattatgatgccaggctcgtacatcaccggtgtacgtgcgaaaggtgtctcgccatacaacaaacgcacatcgggcaacagttctgacaaactattttctttatttttcagtttattaactttatccgccagcaagcggcaaatctcttcacgtttcatatcgcgtaatttcttaggaataatgcggcaatttgattgtgcgcaattttgtagcatttctccagcactctggagaaataggcaagacattggcagaaatgagcattgagagccagggcgctggcgatcacaatgaaaaacatcaggcagatcgttctctgccctcatattggcccagcaaagggagcaagtaatgaacaactttaatctgcacaccccaacccgcattctgtttggtaaaggcgcaatcgctggtttacgcgaacaaattcctcacgatgctcgcgtattgattacctacggcggcggcagcgtgaaaaaaaccggcgttctcgatcaagttctggatgccctgaaaggcatggacgtgctggaatttggcggtattgagccaaacccggcttatgaaacgctgatgaacgccgtgaaactggttcgcgaacagaaagtgactttcctgctggcggttggcggcggttctgtactggacggcaccaaatttatcgccgcagcggctaactatccggaaaatatcgatccgtggcacattctgcaaacgggcggtaaagagattaaaagcgccatcccgatgggctgtgtgctgacgctgccagcaaccggttcagaatccaacgcaggcgcggtgatctcccgtaaaaccacaggcgacaagcaggcgttccattctgcccatgttcagccggtatttgccgtgctcgatccggtttatacctacaccctgccgccgcgtcaggtggctaacggcgtagtggacgcctttgtacacaccgtggaacagtatgttaccaaaccggttgatgccaaaattcaggaccgtttcgcagaaggcattttgctgacgctaatcgaagatggtccgaaagccctgaaagagccagaaaactacgatgtgcgcgccaacgtcatgtgggcggcgactcaggcgctgaacggtttgattggcgctggcgtaccgcaggactgggcaacgcatatgctgggccacgaactgactgcgatgcacggtctggatcacgcgcaaacactggctatcgtcctgcctgcactgtggaatgaaaaacgcgataccaagcgcgctaagctgctgcaatatgctgaacgcgtctggaacatcactgaaggttccgatgatgagcgtattgacgccgcgattgccgcaacccgcaatttctttgagcaattaggcgtgcctacccacctctccgactacggtctggacggcagctccatcccggctttgctgaaaaaactggaagagcacggcatgacccaactgggcgaaaatcatgacattacgttggatgtcagccgccgtatatacgaagccgcccgctaagctttttacgcctcaaactttcgttttcgggcatttcgtccagacttaagttcacaacacctcaccggagcctgctccggtgagttcatataaaggaggaacgtatggctaatccaaccgttattaagctacaggatggcaatgtcatgccccagctgggactgggcgtctggcaagcaagtaatgaggaagtaatcaccgccattcaaaaagcgttagaagtgggttatcgctcgattgataccgccgcggcctacaagaacgaagaaggtgtcggcaaagccctgaaaaatgcctcagtcaacagagaagaactgttcatcaccactaagctgtggaacgacgaccacaagcgcccccgcgaagccctgctcgacagcctgaaaaaactccagcttgattatatcgacctctacttaatgcactggcccgttcccgctatcgaccattatgtcgaagcatggaaaggcatgatcgaattgcaaaaagagggattaatcaaaagcatcggcgtgtgcaacttccagatccatcacctgcaacgcctgattgatgaaactggcgtgacgcctgtgataaaccagatcgaacttcatccgctgatgcaacaacgccagctacacgcctggaacgcgacacacaaaatccagaccgaatcctggagcccattagcgcaaggagggaaaggcgttttcgatcagaaagtcattcgcgatctggcagataaatacggcaaaaccccggcgcagattgttatccgctggcatctggatagcggcctggtggtgatcccgaaatcggtcacaccttcacgtattgccgaaaactttgatgtctgggatttccgtctcgacaaagacgaactcggcgaaattgcaaaactcgatcagggcaagcgtctcggtcccgatcctgaccagttcggcggctaacatgcaaattctcccggtggcggtaatgttccgctaccggacttttcagaaatcatttattcccctcgcgtcccgcccgttgttactcttccttgttcaggaatgccaaatataaggacatcatcatgcagagccggaagctcttaaaagaacaactcatctatatccgggataaacgcaacggagaggtgaaaaacagatgaaaataatacttctgtttttagcagccctggcaagttttaccgtacacgcacagcccccctcacagaccgtagaacaaacagtccggcatatttatcagaactataaatcagatgccactgccccttattttggtgaaaccggagagcgggcgataacttctgcgcgtattcaacaggcgcttaccctgaacgacaatcttacgctgccgggcaatattggctggctggattatgatccggtttgtgattgtcaggattttggcgatctggtgctagaaagcgttgcgataacccaaactgacgccgatcatgccgatgccgttgtgcgctttcgtatctttaaagatgataaagaaaagaccacgcagacactgaaaatggtggcggaaaatggtcgttgggtcattgacgatattgtcagcaatcatggcagcgtcttacaagcagttaatagcgagaatgaaaaaacgctggccgctttagcttcgttgcaaaaagaacagccggaagcctttgttgccgaactctttgaacatattgctgattatagctggccgtggacgtgggtggtttccgactcttaccgccaggcggttaatgccttctataaaaccaccttcaagacggccaataatcccgatgaagatatgcaaatagaacggcaatttatttacgacaatccgatctgttttggcgaagagtcgctattttcacgcgttgatgaaattcgagtcctggagaaaaccgccgattccgcccgcattcatgttcgttttacgctgaccaatggcaacaacgaagagcaagaactggttttacagcggcgcgaaggcaagtgggaaatcgctgattttatccgcccgaacagcggcagcctacttaagcagattgaggcaaaaactgccgccagattaaagcaatgagctgaattaaataacaattagccggaacaataaataaaagggaacactatatgaaaacgattttcaccgtgggagctgttgttctggcaacctgcttgctcagtggctgcgtcaatgagcaaaaggtcaatcagctggcgagcaatgtgcaaacattaaatgccaaaatcgcccggcttgagcaggatatgaaagcactacgcccacaaatctatgctgccaaatccgaagctaacagagccaatacgcgtcttgatgctcaggactattttgattgcctgcgctgcttgcgtatgtacgcagaatgataaaaaaatccccggtagcgtgtcagttgccggggatattttttaacgtccaaccgccgctttaggccgtttcttcgcaccagcattcaccggacgagattgcgtagacgacgctttttttgccgtagcaggcgtctgacgctgggtcgccatcggcgtatgtttcgtcaacgccggacgggtattgcggttctggcgacgagcttcacgcatctcttcaatggttggcgcaggcactaagcaatcgcgacggctgccaatcagatgctttttgcccatcgcttccagcgcctggcggattaacggccagtttgccggatcgtggtaacgcaacaacgctttatgcaaacgacgctgtttgtcgcccttcggtacgaagacgtcttcgctcttataaccaatcttcgccagcgggtttttcccggtgtaatacatggtggttgagttcgccagcggcgacggatagaagttctgcacctggtcgaggcggaagcggtgctttttcagccacagcgccagattcaccatatcttcatcacgcgtaccggggtgcgcggagatgaaataggggatcagatactgctctttacctgcctgttttgagtaagtatcgaacagctctttaaagcggtcatagctgcccatgcccggcttcatcatcttcgataacggcccttcttcggtatgttccggggcaatcttcagataaccgccgacgtgatgggtcgccagttctttgatatagcgcggatcttctacggctatgtcataacgcacaccagaggcaatcaggatctttttaatgcctttcagatcacgcgcacggcgatagaggttgatcgttggttcgtggttcgtgtccatgtgcggacaaatatccggataaacgcacgacaaacggcgacaagtttgttcagcgcgtggcgatttgcagcgcaacatatacatgttggcagttggcccaccaagatcggaaatcacgcccgtaaaacctggaacggtgtcgcggatcgcttcgatctcattaatgatcgaatcttcggaacggctctgaataatgcgcccttcgtgctcggtgatagaacagaaagagcagccgccaaagcagccacgcataatgttgaccgaaaaacggatcatttcgtaagccggaatacgggcattgccataggccggatgtggcacgcgcttgtatggcagcgcaaaaacgctgtccatctcttcggtagaaagcggaatagcaggcgggttgatccacacatagcggtcgccgtgtttttgcatcaatgcgcgggcacagcctgggttggtttcgtggtgcagaatacgcgaagcatgggcgtacagcactttatcgcccttcactttctcgaaagaaggcagcaacacgtaggttttttcccacggtttcgggcgcggtggctgcacggttacggctttggcttcctgctttttcggtgccaccggtttgttatccgcgcacggcaaatcttcaccatacggatgcgggattgggtcgatttttccaggggtatcaagacgggtggaatccacgccgctccagccaggcagcgcctctttcacgataatcgcggtattacgcacatcgcggatttcactaatcggctcgcccatcgccagacggtgcgccacctccaccagcggacgctcaccgttaccaaacatcagcatgtcggctttcgaatccaccagcacggaacggcgcacggtatcggaccagtaatcataatgtgcggtacggcgcagactagcctcaataccgccgaggatcaccggtacatctttccacgcctctttacaacgctgggtataaaccagtgtggcgcgatccgggcgcttacccgcgacgttatccggcgtgtaggcatcgtcatgacgtaaacggcgatcggcggtataacggttgatcatcgaatccatgttgccagcagtaacaccgaaaaacagattcggtttacccagacgcatgaaatcgtctttgctgctccagtctggctgggcgatgatcccgacgcgaaagccctgtgcttccagcatacgaccgcaaatcgccatcccgaagcttgggtgatcgacatacgcgtcgccagtaaccaaaatgatgtcgcagctatcccagccaagttgatccatctcttcacgagacatcggcaaaaacggtgccggtccaaaacaggcggcccagtactgcggccaggagaacaggtcgcgatccggttggatcagggagatagagctcattttgcttccagaaatgataaaaaaataatcaaaggccggggattataagccggaacgaaagagaaatcgaaaagtattccatactcgccctcctcgggcgagtatgaagattacggtaccggattgactaacagttgcccaatcgagccacggtccgccatttccagcgtctgactgttgaagtagaacgggaagtgcgcccaggaaggctgaccgaaataaacaagcagctccacttgtccgtcaacccaaacggtatctttccagcctctgtcttccgggaacggcatcgcgccattcacgttacggatctggaacattacgccttcaatatggaacgcttgcggctcgtccgcgcgtaccgtccagcgttcccacgttccttgctgcgcggtgacatcaatacggttgacgtcccacagctgtccattaatacccgggtcatcacccagactgatatcgcgactgcgaattggcgaaccagccatgatttcagttggcagcaagcgcatcggaagactgtctgtgaccagcggcagaaggccggttgggcgcagcgttagcaccagggtagaaaccagaatactggatggctcaaagaagccacgaatacgatcaacaatgctcgccgcttcgccacaggtgatcgacacttcatcgccgttgctcatatccaccagaatctcgcggcgctcgcccggtgccagcgaaagttgcttcaccgatacaggagcaggcaggaatccctgatcgccagaaatcacatgtaacgggcgaccatcgttcatctgtagttgatagcgacgagagttcgacgcgttcagcagtcgcaagcgcacccagccacgcgagacttcaacgtacgggctttgtacaccgttaaccagcagcgtatcaccaacaaagccgccgcttcccggttcgttgtattctggcgtaccaaagttatccagccgtttatcctggataatgaccggaaaatcatccacaccataatggttggggataggcagcgacttgctgacttcatcttccaccagccacattccggcaaggccgttatagacctgctgagccgtgcggttgggagtattggcgtgataccacagagtagctgcgttctggcgaatgggcagtacgggtgcccagtcagcgtttggcgacatcatccgtgccggaccgcccatcagcgggcctggtacctgtagcccggccaccgtcattgagacattttctgtcaggcggttgctgtaaataagcttaacatcgtcgcccttccagacgcggatagtcggccccaggtaacgaccattgattccccagaccgacgcgcgtgtccctggcgtaaatgaccagtgcgcacgttgtacagtcataaacagcggttgcccacggcgagattcaagtagcggcggaacgggtagcggttgctgttgcccggctgcgctggccttcaggggaacagcgcctgcacaaagtgcaatccccgatgcctgaatgaactgacgccgactgagtgacatatttgctccatgtaaaactggctaaagtaataccgtgcaggaaagtgttccccgcaaaaatacagattgccgacttaaacttttccggcggcttcgcgttctgcgacttctttatcgagctcggcgattttttgttccattatcgaacgacaatgggcagccagctcacgaacctgatctttgccatactgactgacgtcaattggcggcagcatttcgacaatcaccagaccgttgtgcagtcgattaagattaatcttattcgaagttgtagagacgcacacgggaataatcgggacgcccgccgcaattgccgcgtgaaatgctccagtcttgaacggtagcaggccgcgaccacggctgcgggttccttccgggaacatccagatggaaatacggcgttttttgaagtgattcactacttccgcaatggtgccgtgagctttagtgcgattgtttctgtcgatcaataagttgccggttaaccagtacaactgcccgaagaaggggatccacagcaagctctttttacctaccgtcaccgtcggcggttgcacgatgttcgatgctgtcaccatgtcatagttgttctggtggttagcgatatagatagcattgccgtagctttcagcgtctgtaggtttacggcactcaactttcaggccaaacagcggcgcaagacggccaaacatatgcccaaaggtggccacatgtttcgggttacgcgggctgaaaaggcagtaaatggagccgaatacacagactaagatgctgtaaatcacggtaataataagacgaaagatatatagcataacaccctctgaaggtctgagagactggcattgtacgtcacctgaaatcaggttagggcattgttaaaagccgctctctggaaaagcgtattgttaatcgcaacgcatgaataaacaacggtttcaagggaatttttatcgtttccgggggttgaatacgctgccggatgacgacttaacgtttcatccggcgttccttgcaagcgggaggaaacagcgccctccccggcatattactcttcgctatcaccgctgctggcacggcgaggagagtcgatctcaacacgatcgatacgctgcaaaccgcgcatcaacgtaccgcggcgtccacgttcgccagtgactttctgtaactcttccgggcgcagtttaattttgcgtttcccaacatgaatggtcagcgtgctttgcggcggcagaacgtacaattgcgccagaccatcttctccacgcgcggcttctgccgatggaatgttgataatcttgttgcctttgcccttcgacagctgcggcagatcacttaccgggaacatcaacatacggcctgcctgagtgattgccagcagcatatcggaagcatcttcaatcaccaccggcggcataacatgggcattttccggtaaggtgatcaaagccttacctgcacggttacgcgcaaccagatcgttaaaggtgcagacgaaaccgtaacccgcatcggaagccatcagcagtttctgatcgtcgctttccatcagcatatggtcaacggtcgccccaggcggcaacgttaatttgccggtgagcggctcgccctgaccacgcgccgacggcagcgtaatcgggtcaatggcatagctacgaccggtggaatcaacaaacactaccggttggttgctcttacctttcaccgccgctttgaagctatcacccgctttataattcaggcccggcgcgtcgatatcatggcctttagcgctgcgtacccagcccatctgcgacagcacaatggtgacaggttcagacggcagcatgtcgtgctcgctcatcgctttcgcttcttcgcgttcctgcaacggcgaacgacgatcgtcaccgtaggcttgcgcgtctgcctgcagttctttcttcagcaggttattcattttacgctcggaagccaaaatgccctgcaactggtcgcgctctttttccagttcactctgctcaccgcgaatcttcatctcttccagtttggcaagatgacgcagtttcagttcgaggatcgcttccgcctgggtttccgtaaggccaaaccgcgacatcagcgccggtttcggttcatcttcattacgaatgatctcaatcacttcgtcgatattgagaaacgccaccagcaaaccttcgaggatatgcaggcgcttgaggactttctccagacgatagttcagtcggcggcgcacggtatcgcggcggaacaccagccattcggagaggatttccagcaggtttttcaccgccggacgaccatccagaccgatcatattaaggttaatacgatagctcttttccagatcggtggtagcgaagaggtggttcatcacctgatccatatccacgcggttggaacgcggcacaatcaccaggcgggtcgggttctcgtggtcagattcatcgcgcagatcgtcaaccatcggcagctttttgttgcgcatttgcgcagcaatttgctccagtacgcgcgcacctgaaacctgatgcggcaatgcgctgataaccaccgcgccatcttctttcttccacaccgcgcgcatacgcactgaaccacgtccgttctcgtagattttacggatctcggcgcgcgaagtgataatttccgcttcagtcggataatccggcccctgcacgatatccagcagctgatcgagcgtggttttcggctggtcgattaatgcgattgccgcctgagccacttcacgcaggttatgcggtggaatatcggtcgccatgccgacggcaataccggtggtgccgttaagcaaaatgtttggcagacgggcaggtagcattttcggctcctgcaaagtgccgtcgaagtttggcacccagtcagccgtcccctgccccagctcgctcaatagcagctcggaatatttcgacaaccgggattcggtgtaacgcattgccgcgaacgatttcggatcgtccggcgcgccccagttcccctgaccatcaaccagcggataacggtaagagaacggttgcgccatcaggaccatcgcttcataacaggcgctatcgccgtgcggatggtatttacccagtacgtcaccgacggtacgggccgattttttaaatttggcgctggcattcaggcccagttcagacatcgcatacacaatgcggcgctgaacaggtttcagaccatcaccaataaacggcaacgcacggtccatgatcacgtacatggagtagtttaagtaggcgttttccgtaaattcatgtagcgcaaggcgctctgccatatcgctcattaattctgattcctcaacttattcgccagccttcaaaggggcaatattgccggagatactacattatctgccgcgtcgagtcacaggagatcagcgtgaatagcgccgccggacgtgctccgacggcgataaaggcatcaatgtgccttgatatacaactctttgctgtagacataatcctggggattatgcagcggaaaaccgccaacgtagggtttaagcagtttgattaacggctgatagtagataggaatcagcggtgcctgttggttgatgatcacttctgcctgctgatacaacgcattacgctttgtcgcatcagtgatctgcgtggcctggtttagtaaggcgtcatactgcgcatttttccagtgaccgacgttttcttcactatcgcttttgagcgtgttcaggaagctggaagcatcattgtacgtcgcatcccacgactgccgagacagcatgaaatcaccggctcgtcgggcatcaagataggttttccactccattgtgcgcagcgtcacctgtgcacccagccattttttccattcggaagacaacgctatcgcggtcttttcatgcagatcgtacttgttgtagaacagctcaaagcgtagcggatgagaggcgtcgtatcccgcctgtttcagcaaggcttttgccatcgcgacgcgctcactcattggcttttgcagttcatcgaacgtcgtcgcgctaaagccttttacctctggcggcgtcagcgtggttgcgggcgttctcaaccccagtaccttttgcgcaataagctgtcgatcaaccgtaagatatagcgcccgacgcactcgcacatcgttaaatggcggtttctcaaggttgaagttgtaatattcgctgttcagacgcggaataattcgtagctcgccaggcagtgatttttcaatggcgggaatttgctgcgccggaacccaggtgagatcgacctctcccgcgcgatagcggttatagccggtgaccgaattatctagcgccagatactcaacctgttgcaatactgtatgttgcgcatcgcggtactttggatttttgcgtgcagtaatcttttcgttaactacccactgatcaagcacaaaggcaccgttgtaaaccatgttctctggcttactccagctatcgccatgtttagcgatgacatgatgaggaaccgggaacagcgtcggccaggcgagcatcgtcgtgaaccaaggaaccggctgctcaagcgtaacttcaagagtacgatcatccgtcgctttgacacccagcgatgtaacatctgctttacccgcaacaatagctgcggcattgttaatgtgcgcctgtgccagatagccagcaaaagggcttgccgttttcgggtcaaccgcgcgctgccagccgaggacaaaatcctctgccgtcagaggctgaccgtcggaccactgcaaaccgctacgcagatggaaaatatagcgcttgccgccgtccagtatctcccagcgttcagcctgagcgggctgcacctggccttcaccgtccatccataccagaccttcaaacagatccagcacaatctgcgcggcagtattctcctccaccttttgcgggtcgagcgtacctgggtcgctatgattgttgtaacgaaagacttgttgcggggcgagcggtgtgttggcgggaacgtcagcagcgtagagaggagccgcacttaccaggctgaccagccataataaatttcgcgtatacatggtattccttaccggagaaattataagcccaacaacaatacgcctgtggcattgttcgctcaaacttatcgcgagtgatttggctcacactccggtaaagaaaaaagcgagttgcccccgcttttccattaattaacggatttcattcaatagttctggatgcttatccagaacacgtaaaagtttgattgtggaaggatgaggttgggcattgcctttttcgtaacgcgaaaacgcatttacacctcccccaaaaatttcgcttgcctctttttgggtaagagagagcttttttcgaaccttcactataaattcaggtgccactgtttcggcattcaccgaagcccgaaatgcctttacttgcgccatgaaagcatctgactcttctttattcatgatgctctcttcgcaatggacacaatataaaccgtggatacctttcaatactgtttttcgtccacggaaggtgtatggaatatctttaatgccagaaaccatttctccctggtggcaaaccggacatttcatattacttctccttaaacgagacgatcagtacgtcatgaattaccgtaattttaagataaacctggcctgtaacaagcctgggtctgtaaacatcctgccagatagtatgatcagagtaggtggtcatgcttttataaaagtcgctctctgataatccaatgataacattacacataccatcaaaatccaaacctaactcatctgcatttaacagggcactacgtgttgtacgaacttgcccggcattgacaagttttttaacctgactcaaacgtgtatgtggtgtgcgtttttccataacccccgcctccctgttactttagttataacctaaaaggttaattacagcaatgaaaaagcacctaaaaggttagttagatgtacggagatagtgaccacacaaaacgtattctttaaggaaagtgattgaccatataagaaagtggcgcattagtagcgccagtttgaagcaggaatttataagggaagctggagtcaggcatcacgccaacggcacataaacatccgtttccagtcgctgctctgtcaccccttcggcaagattggtgtagtgaaacagaatcggtgctttacgcattttctcgccgcttgcaggcagccagtggcgaatgatgccccataccgtgtgtgaaatatcgtccagctcgccaacgtggcgggccacggcataacgtccaccggtaagttcaccattgctcacaccataacgattatcgggaatcggttcgctaacgctgccgcagatatcaaagcgaaacgcttccggtgcggtggtggcagggtcgtcccaggcgacgccaaaagtctggctttggttaacaggagaaagccccgtctctttacgccacatgataaatttcgccacgctgtagttgagcaattcagggctacagcggtgcggcaacatcgccacaggtattgatgggaaatcgataatgtttacatccagtgtcaggtttgtcattttgcctccctgcgaaattattcccgggaacgcgtcccgggagcggtaacaattacggatttactttgcggatctgtttgacgtcaatttcaacagaattccagtctttatcgacttcaccctgaatctcaaccgtatctttcggcgtcaccgtcacgccgttccagcgtttgtggtcgatatcaacattgatagtaccgctggcatctttgaacacgtagagatcgtcagagatgcgttcaacgatattgccgcgcagggttacccaggtgtcgtcacgcagggattttgcgctttctacagtcgttacgctgccgttcggcccctggaatcctccggcctgactttgcgttgccgatgggccagaaaaaccgccctgctctgctgccatcaccggtgcgctgcacagggccattactgcgattactgctgcgaattttttcatgtttattactccctttaatgtctgtttccgagcatttaacaagatagtccttaacaacttcttaagggaaaaaaataaaatttagtgctgtacagagcgcgttacaacacggtttactggcagcaaatacggttatcgcagggatgaaaaaatgcgaattttactgatagaagatgacatgctgattggcgacggcatcaaaacgggccttagtaaaatgggttttagcgtcgactggtttacacaaggtcgtcagggaaaagaggcgctttatagcgcaccttatgatgcggtgatcctggatttaaccttaccaggcatggatggtcgcgatattttgcgcgaatggcgagaaaaaggtcagcgtgagccggtactgatcctgaccgcgcgcgatgcgctggcggaacgtgtagaagggctgcgtctgggagctgacgattatctgtgtaaaccttttgcgttgatagaagtcgccgccaggctggaagctctgatgcgccgaaccaacggccaggccagcaacgagctgcgccacggtaacgtcatgctcgaccccggcaaacgtatcgccacgctggctggcgaccccttaacactgaaaccaaaagaatttgccctgctggaattactgatgcgtaacgctggtcgggtactgccgcgcaaactgattgaagagaaactgtatacctgggacgaagaggtcaccagtaatgccgttgaagtgcatgtgcatcatctgcgacgcaaactcggtagtgattttattcgtaccgtgcatggtattggctacacattaggtgagaaatgaaatttacccaacgtcttagtctgcgcgtcaggctgacgctaatctttttaattctggcctcggtgacctggctgctttccagctttgtcgcctggaaacaaacaacggataacgtcgatgaattgttcgacacccaactgatgctgtttgccaagcggttaagtacgctcgatctcaacgaaatcaacgcggcggatcgcatggcacagacgccaaatagattaaaacacggtcatgttgatgacgatgcgctgacctttgccatctttacccacgacggcagaatggtccttaatgatggcgataacggagaagatattccctatagctatcaacgggaaggttttgctgacgggcaactggtcggtgaagacgatccttggcgttttgtctggatgacctcacctgatggcaaatatcgcatcgttgttggccaggaatgggaataccgtgaagacatggcgctggcgattgttgccgggcaattgatcccgtggctggtcgcactgccgattatgttaatcatcatgatggtactactgggtcgtgaactcgcgccgctgaacaaactggcgctggcactacgtatgcgtgaccctgactcggaaaaaccactaaacgcgactggcgtacccagcgaagtgcggccactggttgagtcgctaaatcaactgttcgcccgcacacatgcgatgatggttcgtgaacgacgctttacctccgacgcagctcacgaacttcgtagcccgttaacggcgctgaaagtgcaaaccgaagttgcgcagctctctgacgatgatccgcaggcgcggaaaaaagcactgctccaattacattccgggatcgatcgcgctactcgtctggttgatcaactgctcacgctatcgcggctggactcactggataaccttcaggacgtcgcggagatcccgcttgaagatctcctgcaatcgtcggtgatggatatttaccacacggcgcagcaggcgaaaattgacgtgcgactgacactcaatgcccacagcatcaaacgcaccgggcaaccgctattgctaagtttgttggtgcgaaatttgctggataacgccgtgcgctacagtccacagggcagcgtggtagacgtcacgctgaatgctgataatttcatcgtgagggataacggccccggtgtgacaccagaggcactggcgcgaattggcgaacgcttctatcgcccacccggacaaaccgctaccggcagcgggcttgggctatcgattgtccagcgaatcgccaaattgcatggcatgaatgttgaatttgggaatgcggaacaaggtggatttgaggcgaaggtaagctggtaacttctctgtctatgagagccgttaaaacgactctcatagattttactaatagcaaaatataaaccgtccccaaaaaagccaccaaccacaaaccagacaaataccgagcgagaatacatatacccaaaactcgaacatttcccgcataaagagttttcttaagataagaataataagtggcgtaagaagaaaaaatgctgcaatcattgcttgcaatatacgatcttcgcctgaaacggaaggtatactgcaaatatttcctcccgactcaagcatccagtcatacttattgaaagcaaaaaaagagtctattaaccaataagtaagcattatatatagcaatgcttcaaatattgttttaattttctgctttaacatatatcagtacgctcataaaaatccatttataattatcaacatgacacgttgatactttcatattttacttattcaaagccatattttcaatccccaaaaaaaccgaaccaaacgtgtaaattattccggtgcgagtaagaattatgaggaatggctatcagtattgtcattttcagaaaatatttatcctgcatcggtgagtcagagctagatcagacttttgctaaattcgcaaaagactttgcacattttgctaatttcaccgtaccgctctgtgacgtactatagtcggcaaacgtctcactttgaggttaaaaaatgagcaacatcctgattatcaacggcgcgaaaaaattcgcccactccaatggtcaactgaacgacaccctgaccgaagtcgcggatggcacactgcgcgacctcgggcatgatgttcgcatcgttcgcgccgacagcgactacgatgtcaaagcggaagtacaaaactttctctgggctgatgtggtgatctggcagatgccaggctggtggatgggcgcgccgtggacagtgaaaaaatacattgatgatgtattcaccgaaggtcacgggacgctgtatgccagcgatggtcgtacccgcaaagatccgtcgaaaaaatacggttccggcggcctggtacagggcaaaaaatatatgctttctctgacctggaacgcaccaatggaagccttcaccgaaaaagatcagttcttccacggcgttggcgttgacggtgtgtatctgccgttccataaagcaaaccaattcctcggtatggaaccgctgccgacatttatcgctaatgacgtgataaaaatgcctgatgttccccgctatactgaagaatatcgcaagcatcttgtggaaatttttggttaactagagctcaggctttagaaggagttaaccatgcttaccgtaatcgcagaaatccgtactcgtcctggtcaacatcaccgtcaggcggtattggatcagtttgctaaaatcgttccaaccgtactgaaagaagaaggttgccacggctatgcgccaatggtggattgcgctgctggcgtgagtttccagtctatggcaccggattctatcgtgatgattgagcagtgggaaagcatcgcgcaccttgaagcgcatctgcaaaccccgcacatgaaggcgtatagcgaagccgtaaaaggcgacgtgctggagatgaatatccgtattctgcagccagggatttaatcctgccttgtttgcccggccatcctgaccgggcaatgttctttcctttaaacctcaatctccgccatgtcgcctttctcttgcaaccagttgcggcgatcttccgagcgtttcttcgccagcagcatatccatcatcgcgtcagtacgctgatcgtcttcatcatcgatagtcaactgcaccagacggcgagtgttcggatcaagcgtggtttcgcgcaattgcatcgggttcatttccccgagacctttaaaacgctggacgttcggcttgcctttcttgcgttttaattgctcaagtacgccttctttctcttcttccgtcagcgcgtaataaacctctttcccgagatcaatacggtagagcggtggcagtgcgacgtaaacgtgaccgtgtttcaccaacgcgcggaagtgttttacgaacaaagcgcagagcagcgtggcaatgtgcagaccatcagagtccgcatccgcgaggatacagattttgccataacgaagctggctcagatcgtcgctgtcaggatcgataccgatcgctaccgaaatatcatgcacttcctgcgaggccagcacttcgtcggaagaaacttcccaggtgttaaggatcttacctttcagtggcatgatcgcctgatattcgcgatcgcgcgcctgcttggcagatccgcctgcagagtcaccttccacaaggaacagttcggtacggttaagatcctgcgcggtacagtcagccagtttgccaggcagcgccgggccgctggtcagctttttacgcaccactttcttagccgcacgcatacgacgctgggcgctggaaatcgccatctctgccagcaactccgccgcctgaacgttctggttcagccacaggataaaggcatctttcaccacgccagaaacgaatgccgcgcactgacgcgaagagagacgctctttggtctgcccggcaaactgcggatcctgcatttttactgacagcacataggcgcagcgatcccagatatcttccgccgacaactttacaccgcgcggcagaatgttgcggtattcacagaactcacgcatcgcgtccaacaggccctgacgcagaccgttaacgtgcgtaccgccctgcatcgttgggataaggttgacgtagctttcggtcagcagttcaccgccttccggcagccacagtagcgcccagtccacagcttcagtatcaccagcgaaattaccgataaacggtttttctggcagcgtcggtaaaccgtttaccgcttccgccaggtaatcattcagaccgtcctgatagcaccagcgctgttcggtgttgttgatctcatctttaaaggtaatctcaacgccggggcacagtaccgctttggctttcagcacatgcgtcaggcgtgaaacagaaaatcgcgggctgtcaaagaaggtttcatccggccagaagtgcacgctggtaccggtattgcgtttaccgcaagtgccgacaacctgtaaatcctgcaccttttcgccattttcaaaggcgatgttataaacctgaccatcgcggcgcacgttaacttcaacgcgcttcgacagggcgttaaccaccgaaatccccacgccatgcaggccgccagagaactggtaatttttgttagagaatttaccgcccgcgtgcaaacggcaaagaatcagttcaaccgccggtacaccctcttccgggtgaatatccaccggcatcccgcgcccatcgtcaatcacttctaacgactggtcagcatgtaagattacgtccacgcgttttgcgtgacccgccagtgcttcatcgacactgttatcaataacttcttgccccaaatggttagggcgagtggtatcggtatacatccccggacggcggcgaaccggctcaagcccggtgagtacctcaatggcatcagcgttataagtttgcgtcatggtttaagttagcaattcgagttgatcgtcagagatggtgcagaccaagaaaatcgacgatcgggttgaaataatcttcgaagcccgtgaatgcgtggttgccgccttctatgacagtctggcggcaggaagcgtagtacgccaccgcctggcggtaatccagcacttcatctcccgtctgttgcagcagccagatcaaatccggcgcttccagcgggtcaatctgcatgactttgagatcgtaaatatggcgtgactctagcacatattgctgcccggtgtaggggttctcgttctgaccgagatagtccgtcagcagttcaaacgggcgtaccgccgggtttaccaccactgcgggcagcataaaacattgcgacaaccaggtggcgtaatatccccccagtgacgaaccgacaatacccagcgaatcgccgccatgttccaggacaatggattccagcagttctgccgcgtcggaaggatacggcggcaactgcggaatgatcatctcaacgtcagggtgatgttccgccagccagttttttaacaagctcgcttttgcagagcgcggcgagctgttgaaaccgtgtaaataaagaagcgtagacatcagtagccttctgaagcggtatcaggttggaaacgtgtgtccgccaggcgatgcacctcggtggtcagcgtgccatcagcatgtaactcgagagtacgccagccgggcgcgatggtgtccagcgtaaagttggaacagtgcggcttaaactgcacacaggtcgacggcgttgccagcaggcggcgaccgttccagtcgagatccagctcctgatgaatatgaccgcacagcaagtatttgacgtgcggaaacttcgccagcacggtatccagttcgcctgcgttacgcagactgtgttgatcgagccaactacaacccgcaggtagcggatgatgatgcagcagcagcaacgtatggcgttctggcgcatcggccagtttacgttccagccactcaagctgaaactcgctcagctcaccgtgcggcacgccaaacacctggctatccagcaacaggatttgccattgctcaccaataaacacgcgcttcgccggggagatacccgcatcctgtaacgcgctgtacatcgcgggctggaaatcgtggttgccaggcagccagacgcagggcgcacgaaaacttgcgatgccttcagcgaaatgctgataggccgcagaggattgatcctgcgctaaatcacctgtcgcgacaatcaggtcgaattcgtgctggtgtggacgaatcgcctccagcaccgcctggtagctttcccaggtgtttacccctaacagggcttcgtgcttttgtgcaaacaggtgagtatcggtaatttgtaaaatcctgactctggcctcaccagccagaggaagggttaacaggctttccaaatggtgtccttaggtttcacgacgctagtaaaccggaatcgccatcgctccatgtgctaaacagtatcgcaaccagtccgctaaaaactggttaatttgatgcttttcgtcgcgttgatgcaactttttattaggataatcataccgcgctttgaagcgaaaaatctgctggcttgaacacacttcagccaccatcgcgtcatgatacagacgcaccgtcattgacggaaggctccagtaactgatcgcgggcgcagtctgttctattgtcaccagggtagtgtatcgggtcgattccacaatcgtcagccgatattgtgcgtttgccacctgatagcttacagtttcgccgggtgcgtcattgcgcggtaacaaacggcgcaattgtgaaaagttcatctcgcacaggcgcatcatttcaggaaagtcaggtgtgtaacgcttcatttatgcccactcattttttaacgcttgatgatgcagctgcagccattgcaaagcgatgaccgacgctgcgttgtcgattttcccctcttctacccactggtatgcctgttcccggcttaccacatgaacgcgaatatcttcgttttcatcagccagaccatgaataccgcttgcggtcgtggcgtccacttcgcccaccataattgacgaacgctcactggtgcctcccgggcttgccaagaaacttaacaccggtttggtccgtttgactatcagtcccgcctcttcaatcgcttcgcgacgggcaacatcttccacactttcaccctcttcaatcatcccggcaaccatctccagtagccagggggtttcactggtgtcgtatgcggcaatccgaatctgctcaatcagcacaacttcatcacgcactgggtcaaagggtagcaagactgcggcgtgaccgcgctcaaaaatttcccgccgtacctcatgactcatttgcccgttgaataaacgatgacgaaatctataaagatctaatgaaaaaaagccgcgataaagtgtttctcgtgcaataatttctacatcgtttttgccaaatgtaacgggcaggctgtctggcttaagcattgttaatgtcctggcactaatagtgaattaaatgtgaatttcagcgacgtttgactgccgtttgagcagtcatgtgttaaattgaggcacattaacgccctatggcacgtaacgccaaccttttgcggtagcggcttctgctagaatccgcaataattttacagtttgatcgcgctaaatactgcttcaccacaaggaatgcaaatgaagaaattgctccccattcttatcggcctgagcctttctgggttcagttcgttgagccaggccgagaacctgatgcaagtttatcagcaagcacgccttagtaacccggaattgcgtaagtctgccgccgatcgtgatgctgcctttgaaaaaattaatgaagcgcgcagtccattactgccacagctaggtttaggtgcagattacacctatagcaacggctaccgcgacgcgaacggcatcaactctaacgcgaccagtgcgtccttgcagttaactcaatccatttttgatatgtcgaaatggcgtgcgttaacgctgcaggaaaaagcagcagggattcaggacgtcacgtatcagaccgatcagcaaaccttgatcctcaacaccgcgaccgcttatttcaacgtgttgaatgctattgacgttctttcctatacacaggcacaaaaagaagcgatctaccgtcaattagatcaaaccacccaacgttttaacgtgggcctggtagcgatcaccgacgtgcagaacgcccgcgcacagtacgataccgtgctggcgaacgaagtgaccgcacgtaataaccttgataacgcggtagagcagctgcgccagatcaccggtaactactatccggaactggctgcgctgaatgtcgaaaactttaaaaccgacaaaccacagccggttaacgcgctgctgaaagaagccgaaaaacgcaacctgtcgctgttacaggcacgcttgagccaggacctggcgcgcgagcaaattcgccaggcgcaggatggtcacttaccgactctggatttaacggcttctaccgggatttctgacacctcttatagcggttcgaaaacccgtggtgccgctggtacccagtatgacgatagcaatatgggccagaacaaagttggcctgagcttctcgctgccgatttatcagggcggaatggttaactcgcaggtgaaacaggcacagtacaactttgtcggtgccagcgagcaactggaaagtgcccatcgtagcgtcgtgcagaccgtgcgttcctccttcaacaacattaatgcatctatcagtagcattaacgcctacaaacaagccgtagtttccgctcaaagctcattagacgcgatggaagcgggctactcggtcggtacgcgtaccattgttgatgtgttggatgcgaccaccacgttgtacaacgccaagcaagagctggcgaatgcgcgttataactacctgattaatcagctgaatattaagtcagccctgggtacgttgaacgagcaggatctgctggcactgaacaatgcgctgagcaaaccggtttccactaatccggaaaacgttgccccgcaaacgccggaacagaatgctattgctgatggttatgcgcctgatagcccggcccccgtcgttcagcaaacatccgcacgcactaccaccagtaacggtcataaccctttccgtaactgatgacgacgacggggcttcggccccgtctgaacgtaaggcaacgtaaagatacgggttatctgccgcattcttcccccttctcgcttcaatttcgaccagccatcctctattctgatgggtatttaccactggtcccggaagacaaaaatgaaacggacaaaatccatacgccacgcatcgttccgcaaaaactggagcgcacgccatctgacaccagtcgctctcgcggttgccactgtttttatgctggctggctgtgaaaagagtgatgaaacagtgtctctctatcaaaatgctgacgactgttcagctgcaaacccaggcaaaagcgccgaatgtaccaccgcgtacaacaatgcgctgaaagaagccgaacgtactgcgccgaaatacgccacccgtgaagactgtgttgctgaatttggtgaaggtcagtgccagcaggcaccagcccaggctggcatggcaccagaaaaccaggcgcaggcccagcaatccagcgggagtttctggatgccgctgatggccggttacatgatggggcgtctgatgggcggcggcgcgggatttgcacagcagccgctgttctcctcgaaaaacccagccagtccggcttacggtaaatataccgacgcgacgggtaaaaactatggcgcagcccagccaggccgcaccatgaccgtaccgaagacggcaatggcaccaaaaccggcgaccaccactaccgttacccgtggcggttttggtgaatctgttgccaaacaaagcactatgcagcgtagtgcaaccggtacctcttctcgttcaatgggtggctgataccgatggaaagagtcagtattaccgagcgcccggactggcgtgagaaagcccacgaatacggtttcaattttcacaccatgtacggcgagccgtactggtgtgaagatgcttactacaagttgaccctcgcccaggttgaaaagctggaagaagtcaccgccgaactgcaccagatgtgcctgaaagtggtggaaaaagtgatcgccagcgatgagctgatgaccaaattccgcattccaaaacacacctggagttttgtgcgccagtcatggctgacgcaccagccatcgctttattctcgtcttgatctggcgtgggatggcactggtgaacctaaacttctggaaaataacgccgatacgccaacgtcactatacgaggcggcgttctttcagtggatctggctggaagatcagcttaacgccggtaacttgccggagggcagcgaccagtttaacagtctgcaagaaaaactgatcgatcgcttcgttgagctgcgtgaacagtatggcttccagttgctgcatctcacctgctgtcgcgacacggtggaagatcgcggaaccattcagtatttgcaggactgcgcaacggaagctgaaattgctactgagttcctctacatcgatgatatcgggttaggtgaaaaaggtcagttcacggatttacaggatcaggttatttccaacctgttcaagctgtatccgtgggagtttatgctgcgtgagatgttctccaccaagctggaggatgcaggcgtacgctggctggaaccggcgtggaagagcattatctccaacaaggcacttctaccgctgttgtgggagatgttcccgaatcacccgaacctgctgcccgcttattttgcggaagatgatcatccgcaaatggaaaaatatgtggttaagccgatcttctcccgtgaaggcgcaaacgtgtcgatcattgagaacggcaaaaccattgaagcagcggaaggtccgtatggcgaagaaggaatgattgttcagcaattccacccgttaccgaaattcggcgacagctatatgctgattggtagctggctggtgaacgatcaacccgccggaattggcattcgtgaagaccgtgcattgatcacccaggatatgtctcggttttatccacatatttttgttgaataagccacgataccggatggcactcgccatccggtaattgttagcctatctgcaccgacagcatactcaggctgcccatttctataccctcaaccggaatggtaattggctcctgcccatcccacgcacctaacacatacaacaacggcaaataatgctctggcgttgggttcgataacgtgccaccttcatggtcgaggtaattcaccagaggatgttgttccactggcccttgccacgtcagattcgctttcacatactcattaaacgacgtcgcccacggatacggtgaactatcaccgtgccacttcactgtgcgcaggttatgcaccacgttaccgctggcgaccaacattattccttcatctcgcagcgctgccagtttgcgccccatttcgaaatgccaggcggcaggtttgctactgtcgatactcaactgcaccatcgggatatcagcgtcaggatacatcttaatcagcacgccccacgagccgtggtcaaagccccaggcttctttatccagcgtcaccgggatcggcgctaacagctcaaccagacgctgtgccagcgcaggcgaacccggagcaggataatgcgtatcgtacagcgcctgcgggaagccaccaaagtcatgaatcgtgggcggcgtctccatcgcggtcactcctgttccacgggtaaaccagtgagccgaaaccaccacaatcgcttgcgggcgtggcaatgtcatccccaacttctgccagctgcgggtatacaaattatcttccagcacgttcatcggactaccgtgacctaaaaacaatgctggcatacgtgttgaagacatgatgatatccttaactaaaggtgtcattttgatatcctcacaatacgcttgttcggcggagtaagaacccggataacaatgatgatgatcatcagttattttgacgatctgcctgaaggtgaagatttataaggagttgtcgatgtcagtacctctcattctgaccatactggcgggggcagccacgtttattggcgcgtttctcggcgttctcgggcaaaaaccctcgaaccgcttactggcgttttcgctaggttttgcggcggggatcatgttgctcatctcattaatggaaatgcttcctgccgcactagcagctgaaggaatgtcgcctgtgttgggttatggaatgtttatcttcggtctgcttggctattttggcctggaccgcatgttgccacatgctcatccgcaggatttaatgcaaaaatcggtgcagccgttgccaaaatcgatcaagcgcacagccattctgctcactctcggcatcagtctgcataacttcccggaagggattgccacctttgtcacggcgagcagcaacctggagctgggatttggcatcgcactggccgtcgcgttgcacaatattcctgaaggtctggcggttgcaggcccggtttatgcagcaacgggttctaaacgcacggcaattctgtgggcggggatttctggattggcagaaattcttggtggtgtgctggcgtggttaatcctcggtagcatgatttccccggtggtcatggcggcaatcatggcggcggttgcaggaattatggtggcgctctcggttgatgaattaatgccgctcgccaaagagattgaccctaataataaccccagctatggcgtactatgtggaatgtcagtgatgggattcagtttagtgctgctacaaacggcgggaattggttaaaaacaacatcagaagttgtccagcatatggacaacttctgccagcttcacgaaagccttattctaccttttcggctgtctcttctctcgtactgtttaagtatttgttccgcgcttcaagcagtgcgtctctgtcctggcgaaacgcccgacaataacgtttcaaatgcaggaaataacccaccacaaccagagcaatcaatacaatccagtaccaggcgataaacatccttttacccttaatatttaacaatactaaacatttagcgcataaatttcacatatcctttttcggatatattcatatggtcgcataataacggaacaattatatgattttgatcataatgaaaaagaatgcctgatattaatgaaattttctcatagaaagagaagcggaattaacatcttgcatagcagggaaaaataaaaaccgaagcctgctacaacttcggtttcttgattaaggcagtaaattaagcagcggttttcagctggctttacgctcatgtgcctgacggtatgccaccaagtcttcaatagtcacgagcgccatgttgtgtttattggcaaactcaatgcactctggtgcacgcgccatcgtgccatcgtcattagtcagctcacacagcacaccagccggtttaaagcctgccagcgtcatcaaatcaatagtcgcttcagtatgaccgccacgcgtcagtacaccacctgcctgcgcgcgaagtgggaaaacgtggcccgggcgattcagatcagaaggttttgcgccatcggcaatcgctgcgcgaacggtcgtaatacgatcagcggcagaaacaccggtagtcacaccttcagccgcttcaatggtcacggtaaaaccggtgccataggcgctggtgttattttctaccatcattggcagatcaagttgtttacggcgatcttcagtgatgcacaggcaaacaataccgctaccgtggcgaatggtcagcgccatctgctcaacggtcatggtttctgccgggaagatcatatcgccttcgttttcacggtcttcatcatcaagcaccattacaccgcgtccttcacgcagcgcagccagtgcattttcaacacgttcgaaaggcgtaccaaaagaggaaagtagcgtctgattcatggtaaaaaaacctcactaaaattatggttaccagaatcagggcagtcttaggagtggcggcatatagccaaaataacgtgagcgggtccatgcccgacagaatcgttactctctcccatccggactctaaccgtcggccccggaattacaccggatctgctgtcctttgagttcgcactcaaagcgctcgcgggctttcaaccaagttgatttaccgccggtggggaatttcgccccgccctgagaataagcggattcactataacgctaatgattagcggcagcaacgcatagcttcacataattctggtttatgacttacccttatcgcactacaatggcactcaacacctatcagtacagggaaactacaatgattgacccgaaaaaaattgagcaaatcgctcgccaggttcacgaatcaatgcctaaaggaatcagggagttcggggaagatgtggagaaaaaaatccgccaaaccctacaagcgcagctgacgcgcctcgaccttgtaagccgtgaagagttcgacgtccaaacgcaagtcctgttacggactcgtgagaaactggcgctgcttgaacaaagaatcagcgaactggaaaatcgcagtactgagatcaaaaagcagccagatccagagactctccccccaacgctgtaaacatttgtctttaatgcactgtaaattatgaattaatcctctaatttacagtgttttctattacattatcgcttaatcccattcagagtatcatcacaaaaatgaatgattgcaattgaaaatataattgttatgtattctttaagttttacttaatcgatatttagataaactaattttataaaaatcacaaaacaaaatataatattttaatgattggtagtccttaaataacagttactaatcattctcttttttacttatctttatataaaggaatattatgtctgcttttaaaaagtcacttcttgttgctggtgtagcaatgattctttccaataacgtgtttgctgatgaaggtcacggtattgttaaatttaaaggtgaagttatctctgctccatgttctattaaaccaggtgacgaagatttaactgtaaatctgggtgaagtagcagataccgtactgaaaagcgatcagaaatctttggcggaacctttcactattcacctgcaggactgcatgctgagtcagggtggaactacttattcaaaagcgaaggttactttcactacagcaaataccatgacgggtcagtctgatcttctgaaaaataccaaagaaactgaaatcggcggcgccactggtgttggcgtacgtattctggacagccagagcggcgaagtaactttaggtactccggtagtaattacgttcaacaataccaacagctatcaggaactgaatttcaaagctcgtatggaatccccaagcaaagatgccaccccgggcaacgtttacgctcaggctgactacaagattgcttacgagtaatcgcatttggccgggttcacccggccacatcattaacggattaatgataagtggatcagatgtataaaaaattaaaattaaccacaataagcgaattgattaaaaatatttattgttcattatccgttatcatcattggttgtgcgtcagcttatgccgttgaattcaacaaagatttaatcgaagccgaagatcgtgaaaacgttaacctttcccaatttgaaactgatggccaattacccgtcggcaaatattcactaagcactctgattaataataagaggacgccaatccatctggacctgcaatgggtattaattgataaccaaactgcagtttgtctgactccagagcaattaacattattaggctttactgatgagattattgaagaggctcagcaaaacctgatcgatggttgttaccctatcgaaaaagaaaaacaaattacaacttatctcgataaagggaaaatgcaattatccatatctgcacctcaggcatggttaaaatacaaagatgcaaactggacgcctcctgaactttgggatcatggtattgctggggcatttcttgactacaatttatatgcctctcattatgcaccacatcagggcgataattcacaaaatataagttcctatgggcaggctggggttaatcttggggcctggcgcctgcgtactgattaccagtacgatcagtcatttaacaatggcaaaagccaggcgaacaacctggattttccgcgtatttatttgtttcgcccaatcccagaaattaatgcaaaactaactataggtcaatacgataccgaatcgtctattttcgactctttccatttttctggcatttcgttgaaaagtgatgaaaacatgttaccgccagatctacgtggttacgcaccgcaaatcacgggggtcgcacaaacgaatgcaaaggtcactgtctcacagaacaaccgtattatttatcaagaaaacgttcctccaggcccattttctattaccaatttattcaatacattacaggggcaactggacgtcaaggttgaagaagaggacgggcgcgtcacgcaatggcaagttgcatctaatagcattccttatctgacgcgtaaagggcagattcgctacactactgcaatggggaaaccgaccagcgttggcggcgattccttacaacagcccttcttctggaccggtgaattctcatggggttggctgaacaacgtatccctgtatggtggttcagtattaacaaaccgtgattatcaatccctggctaccggagttggttttaaccttaactcgttgggctcattatcctttgatgtcacgcgatctgatgctcagttacataatcagaataaagaaacgggttatagctaccgtgctaactattcaaaacgttttgaatctaccggtagccagctcactttcgctggctaccgtttctctgataaaaactttgtgtcgatgaatgaatatatcaatgacactaaccattacacgaattatcagaatgaaaaagagagttatattgtcacgtttaaccagtatcttgaatcattgagattaaatacatacgtaagtctggctcgtaatacttactgggacgccagcagtaatgtgaattattcattatcacttagccgcgattttgatatcggcccattaaaaaacgtatccacctcactaacatttagccgaataaactgggaagatgacaaccaggatcaactgtacctaaatatttcaattccctggggaaccagtagaacattgagctatggtatgcaacgaaatcaggataacaacatttcgcatactgcttcgtggtatgactcttccgatcgaaataattcctggagcgtttctgcttcaggcgacaatgacgaatttaaagatatggaggcgtcactgcgcgccagttatcagcataataccgagaacggtcgtctctatctctccggtacatcacagcgggacagctactattctctgaatgccagttggaacggttcattcactgcaactcgccacggcgccgctttccatgactatagtggtagtgctgactcgcgttttatgatcgacgcagacggcgctgaagatattcagttgaataataaacgcgcggtaactaatcgttatggcatcggagttattccatcagtcagcagttacataacaacatcattaagcgttgacacccgaaatctgccagaaaatgtggatatcgaaaactcggttatcaccaccaccttaaccgagggtgctattggctacgccaaacttgatacccgcaaaggctaccaaatcatggggattattcgcctggcagatggtagtcacccaccactggggattagcgtaaaagatgaaaccagccacaaagaattaggacttgttgctgatggcggctttgtatacctcaacggcattcaagatgacagcaaaattactttacactggggtgacaaatcttgttttattcaacccccccccaatagcagcaacttaaccaccggaacggttattttaccgtgtattagctaaaattaattcaggatgaaactaatgcgctacttaaatacaaagaatatcattgcagcaggagtattactctcctgcatgaacagcattgcctggggtgccatcatcccggatcgtacccgtataataatgaatgagtcagataaaggcgaagcattaaaacttactaatcaaagtaaaaaactgccctatctggcccaaacatggatagaagatacgaaaggcaataaatctcgtgactttattgttacggttcctcctatggtgcgtttaaatcccaatgagcaaattcagattagaatgataactcaggaaaaaattgctcaacttcctaaggacagagaaactctgttctattttaacgtgcgagaaataccgccaaaaacagataaaaaaaatgtgatgcaagtgactatgcagcacgctttgaaattattctggcggccaaaagccattgagttagaagacgatggggtaatgacttacgaaaaagttgaaatcatccgtagaaatgatggttcgatccgctttaacaataaaatgccttatcacgttacgctgggttatatcggaacaaatggggtcacgatgttaccgcaaacgcaaagcttaatggtcctcccttttagccatgcagatacgcagtttaaaaatgttccatcaacttttcaggttggttatatcaatgattttggtggcttaagtttttatgaaataaactgcccaacagtgaataattcttgtaatgtttccgtagccaaacgagataaataaaatgcgctacttattaactgtaattgcatttattatgggttttagtgcgttacctgtatgggcgatgaactgctatgctgaacatgaaggggggaataccgtagtcataggctacgtaccaagaattgctatccccagcgatggtaaaaaaggtgataaaatctggcaaagcagtgaatattttatgaatgtcttctgtaataatgcactacccgccccatcaccaggagaagaatacccatctgcatgggtaaatataatgatgttgttagcatcaggtcaggacttttataatcaaaactcatatactcttggtgtaacctataatggagtcgattatgattcaacctccacacgagctatcgcagcaccagagtgcattgatgttaaaggcgcagggatatacagtaatacctataaaaaccccgctgtctgtagcggtggtcctgaacctcaattgtcagtaacttttccagtacgtgtacagctgtatattaagctggctaaaaatgctaataaagtaaataaaaaacttgtattacctgacgaatatatcgccctagagtttaaaggtatgagtggcacaggaactatagacacagacaaaaatttgaccttcagaattcgtgggttaaataatattcatgtccttgactgctttgttaatgttgatctggaaccagctgatggcgttgtcgactttggtaaaataaattcccgaacaattaaaaataccagcgtgagtgagacgtttagcgtagtcatgaccaaagatccgggtgcggcctgtactgagcagtttaatattttagggagttttttcactacggatattttgagtgattatagccatctggatataggtaatggtctgctattgaagatatttcataacgatggaacagcaacggaatttaaccgcttctcacaatttgcttctttttcatcgtctagtgcgccttcggtcaccgcaccattcagggcagaactgagtgcgaacccggcagaaacggttgttgagggaccgtttagtaaagacgtaatcctgaaaatcacctataactagtatctaatacaaacactaaaacgggccatcaggcccgttatatcagtgctctaactccagctctcttgcctgcatcatctgttgacaataccaggcataacgtgcgcaaaaccaggttctatgttcttcatccatgttaccagtaacggccagaatatcgaccgggcgaccttctgcgtgcattctggcaaaactacgcgccaggaaatcgaaattatttaaagaattaagactatgatccataagcacatcctccggttatcgcataccttttaaggccatatgctttttctgatttcagtattccccaatcagtgtagtgcctttaaacataacgtgcgtaaatatattgtccccgatcacactttttagtgaaaaataaaaaaccatattaaaagactttctcttccagaacttctctaacctgtgttattattagcgtagataaatgtaagcaaggaaactattacaaagtaaatattgcgtcacgaaatggacattggagtgatatatgattttattcgccgactataacaccccttatcttttcgctatttcctttgtactgctgatcggcctgttagaaatttttgcgcttatctgcggtcacatgctctccggtgctcttgatgcacatcttgaccattatgattccataaccacaggtcatatgagccaggcacttcattatctcaatattggaagattgccagctctcgtcgttctctgcttactggctggtttttttggtcttattggcatcctgttgcagcatgcctgcatcatggtctggcaatcaccactgtcgaacctgttcgtggttcctgtcagtttactgtttacgattattgcggtgcattataccggtaaaatagttgcgccctggattccacgcgaccatagttcagctattacagaagaagaatatattggtagcatggcgttaattaccggtcatcaagccacttcaggtaatccctgcgaaggaaaactcaccgatcaatttggccaaatacattatttactactggagcctgaagaaggaaaaattttcactaaaggagacaaagtgttaattatttgccgactttctgcaacgcgatatttggcggaaaacaatccctggccccaaatattgtaatttattaatcaaaaggaaatttaataatggatgatattgttaattctgtgccctcctggatgtttaccgcgattattgccgtatgcattctgtttattattggaattattttcgccaggctctatcgtcgcgcttcggcagagcaagcttttgttcgtactggtttaggtgggcaaaaagtggtaatgagcggtggcgcaatcgtgatgccgatctttcatgaaataatccccatcaatatgaatactctgaagctggaagtcagccgctcaaccattgatagcctgattacgaaagatcgtatgcgcgtcgatgtagtagtcgctttctttgtgcgggtaaaaccttcagtagaagggattgccaccgctgcccagacgctggggcaacgcaccctgtcgcctgaagacttacgtatgttggttgaagataaatttgtcgatgccctccgtgcaacagctgcgcaaatgaccatgcatgagttacaggatacccgcgagaacttcgtgcagggggtgcaaaatacagtggcagaagacctgtcgaaaaacggtctggaactggagagcgtttcacttaccaactttaaccagacctcgaaagaacatttcaatccgaacaatgcctttgacgccgaaggtttaaccaaactgactcaggaaacagagcgccgtcgccgcgaacgtaacgaagttgaacaggatgtagaagttgcggtgcgtgaaaaaaatcgcgatgcgctatcgcgcaagctggagattgaacagcaagaagcgtttatgacgcttgagcaggagcagcaggttaaaacccgtactgccgaacagaatgcacgtattgcggcttttgaagctgaacgtcgtcgtgaagcagagcagacacgaattctggctgaacgacagattcaggaaacagaaatcgatcgctattgccgccaaatcggaacaacagtcccaggcagaagcgcgtgctaatctcgcacttgcagaagcggtaagcgcccaacaaaacgtagaaaccactcgccagactgccgaagccgatcgtgctaaacaagttgccctaatcgctgccgcgcaggatgcagaaaccaaagcggttgaactgaccgtgcgggcgaaagcagaaaaagaagccgcagagatgcaggcggcggctatcgttgagttagccgaagctacacgtaaaaagggtctggcggaagcagaagcacaacgtgcgctgaacgatgctatcaacgtactttctgatgaacaaaccagccttaaactcaaactggccttgttgcaggcgctgcctgcggtaatagagaaatccgttgagccgatgaagtcaatcgacggtatcaagattattcaggtcgatggtctgaatcgtggcggcgctgcgggtgatgcgagtacaggtagcgttagtggaggaaaccttgcagagcaggcattgtctgccgccctttcttaccgcacacaggcaccgctgattgactccttgctcaatgaaattggtgtttcaggcggctcactgacggcattgacttcacccttaacctcaacaactcccgtcgccgaaaacgtagaataaattttcagctatgaacgtccctggcacaaaaagccggggattttttatatctgcgttccgctaaaaagtgcaaatgatcaggttgttgcagcattttgcgtgacggctcggggaaggcaaaactgcatcagagaaagcattgcgtggggtctggcgctcatcaacaatcggggagtcagcagggggctgaaacgggaaagcccctcccgaagaaggggccttacagaaggaaagggttatgatgaagctcgtcatcatactgattgtgttgttactcgtaagtttcgcagcttattaacagccaatcagaggggggagaaatcctccctcacccttgttcctttactttaggttgaaaaaaaatcagcgtcaagaaggtttcattaacacatatccctggcccaaaaagccggggattttttatatctgcgttccgctaaaaggtgcaaatgctcaggacgttgcagcgttttgcgtgaccgctcggggaaggcaaaattgcctctgggaaagcattgcgcggggtccggcgctcatcaacaatcggggggcagcaaggggctgaaacgggaaagcccctcccgaagaaggggccttgtataaggaaagggttatgatgaagttcgtcatcatactggttgtgttgttactgttaagtttcccgacttactaacaactcatcagaggggggagaaatcctcccttacccttgttcctttactctaggttgaaaaaacaacagcgtcaataggcctgccatgtacgaagcgagatctgtgaaccgctttccggttagccttttttatcctgttggatcttcttgatgatgttggtcgtcgagcaaccgtcttcaaagttgagcaccaacacttcgccaccgttggcccagacttctttactcccggcaatctcttctggtttatagtcgccgcctttcaccagcagatctggcaagatcccggcgatcaagcgctgcggcgtgtcctcttcaaacgacactacccagtcgaccgcttccagtgcgcccagcacaatcatacgctgttcgagtgggtttaccgggcgggaatcccctttcagccgtttggtggaggcatcgctgttgacggcaacaatcaagcggtcacccagcttgcgggcatttgccagataagagacgtgcccggcgtgcaggatgtcaaagacaccgttggtcatcaccactttttcaccacgtttacgcgctgccgctacggccagcttcagttcctcttcggtcatcacgccaaagcctgtatctgcacgtccacgtacagcattttccagctcgatcggcgaaaccgtggaggttcccagtttgccgaccaccacgccagccgccgcattggcaaagaagcaggcttcttccagcgaattacccgctgccagcgttgccgccaggacgccaatcaccgtgtcgcccgcaccggtaacgtcatacacttcctgcgcttgggttggcatatgcagcggcgctttacccggttgcagcagcgacataccctgttcggaacgggtcactaacagagccgagagttcgtaatcggcaatcagtttcatgccgcgctcaacaatctcttcttcggtcttacatttaccgacaacagcttcaaattccgagagattcggcgttaacagcgtagcgccgcggtagcgctcaaaatcggtactttttggatcaatcagcaccggaacacccgctttacgcgccagttggatcatctgctgtacgcttgccagcgcacctttggcgtagtcagaaagcaccagcgcgccaatcgaactcagcgcctgattaatccgctcgtgcagcggctgcggatcaacaccttcgaaaccttcttcaaaatccagacggatcagctgttggttgcgggaaagtacccgtaatttggtaatggtcggatgcgtcggtacagaaacgaagtcgcatttgacgttgacgtcggccagagatttactcagcgcgcgcgctgcatcgtcaatgcccgtcaacccgaccaggcgtgcattagcaccgagagaagcgatattcatcgccacgttagccgcgccgcccggacgttcttcgatggtattcactttaaccacgggcaccggcgcttccggcgagatacgactggtggggccgtaccagtaacgatccagcatcacatcaccaaccaccatcactcctgcacgttcaaactctggcagcgttactttcattcctgtctcctgagagattcaaaatttgcgcgcgataataccatacttcattcttccaccagccacttctgccagcttgcccgcaccagttcacgctctgcggtgaagcaatcctccgacacatggcccggcaattcctgtaatgccagatgatgaagttcatcgcgaagcgtagtgtaagcacgggtcagcgccatcgcttcctgctcttccataatgtcgttttgcgccagtagttccagaatacgcacgttgtctgaccagcgcgttaacttcggtttttcatgagcgtagcgcaacaccagatattgggtaataaattcgatatcggtaattcccccttcatcagctttgatatcaaagcgatcgcgatgtttattgccgagatgagcgcgcattttctcgcgcatttcccgcacttccgtttgcagagttttaccttcacgcggcagcgtcataatctcgcgacgcactgcgtcaaagtgcgcggtgagctgcggatcgccgtacactacacgcgcacgcaccagcgcctgatgttcccacgtccaggcctcgtttttctgataatcggcaaatgcttctgcggatgtcaccagcattcccgccgccccggacggacgcagtcgagcatccacttcatacaaaatgccggaagaggtacgcgtactgaacagatgcataatgcgttgcgccagacgcagataaaactgccgcccgtcgatttcccgctcaccgtcagtcatcgcatccattgggcaatcatggaggaagataaggtcaagatcggaactgtagcctaactcccagccgcccagcttgccgtagccgaccaccgcaaaaccacgcccttcgcgttcgttcaggtgattcggcttaccgtagcgggcaaccatttgaacccacgcctgctgaacgacggcatctatcatggcttccgccagccaggttaagtgatcgctcactttcatcaccggtagcgtaccggcgatatccgctgcggcgatgcgtaacagctgcgcctgtttgaactgacgcagcgcctcaagctgttgctcttcgtcatcttccggcacgcgcagcaaatactggcgcaactcatcgcggtaggcatcggtcgccgtcggctggtaaagggtgtttggatcgagcaattcatccagcaataatggataacgcgccagctggctggcaatcatcggcgacgcggcacacagagaaatcaaatgtttaagcgccgcggggaattcactgagcaattctaaataggtggtgcgggtaacaatccccaccagcaaggcggtaatgcgcgacagcgtaacggcagcgtcttcacgcgcacagacatcacttagcagatgcggcatcagatggtcgagcacctgacgtcctcgcggcccgatggtgcgcttatccagctctttgcggaaatcggcaatcagcgttagcacctgtttgcgatcatcctcgctaagatgcgccagcactggcgtagtgtcatcttcctgcaacgcatcctgccacagctcacgccactgttccgacagcgactcttcctgagtttcactttcatcgtcgccaatcaattcattaaacacccggcgcacattggtcatatgtgcggtcagcgccccggtcagttgcggccagtcagcaaagtccatcgcccacgccagccgcgcacgattaagctcatcagaaggaagcgtctgggtttgttcgtcgttaatgctttgcagcaggttttccagacgccgcaggaacagatacgccactcgcaattgttcagcatcgttttcagaaagcagatgcagcgcagcaatgacgctgagcgttggcagtaaagagcgcgactgcagcgacggttcgcgcccaccgcgaatgagctggaacacctgaacgataaattcaatttcgcgaatgccgcctgcgccgagtttgatattgtcggtcaaaccacgtcgacgcacttcacgggcaatcatccctttcatgttgcgcagcgactgaatcacgctgaaatcgatgtaacggcggaaaacaaacgggcgcagcatcgcacgcaactcgttagcatagacgccttcgctatcgcccataatccgcgccttgaccatcgcgtaacgctcccagtcgcgcccctgctcctggtaataatcttccaacgcggcaaagctcagcaccagcgggccactttcgccaaacggacgcagccgcatatccacgcgatagacgaagccatcctgcgttggttgatccagcactttaatcagccgctgccccatgcgggtaaaaaactgcgcgttatccagttcccggcgtccaccctgcgtacaaccatgttccggccaggcaaaaatcagatcgatatcagaggagaaattcagctccccaccgcccagcttacccatgcctaaaatcagcagcggttgcgcttcgccctgcgcattgcacggcgttccccactcgcggcagcaggcgtcatacagccagtcacgcgccgcaacaatcagcgtctccgccagatagctgagctgctgcaatatgctctcttcagtaaccagtgccagcgtttgcgcccaggcgatgcgcaccataatgcgccgccggaatagccgcagctcgcgcattaacccggcttcgtcactcacattacagagcgcctcctgcaaccatgccgcgtaatgctgccattcgtcggcctgcggcggttggctttccagttccgtcagccactctggatgcgcaatcacgctgtcctgcacaaaatcactaaaagtaagtactgacttcgcctgtgcgctaagtgattcctcggctaaaggctctggcagccgctcaacaacggtctgccagtactgctgtaacggtgaagagagcggcttcataagcgattttatccttgcctgattaacgttttccgctgtgcaaccagaacggttcctgattgtttgcctcattacggaaatgttcaatttcgatgcgttgcccggtcgcaatagcgtgatgcagcccctgccagttctccagccaggcttgcgcgacgacaggatcatagtaacccgccagcaacagtattgagtcaatatcacgcgtcaggcgtggcaactggtcacggtagcgatcgcctaacggctggcagaaaacgcttttcagttcagcggcatggcgggaaagatggatatcggcaaagcgtttgaaggagtcgctgattttgccctgcgctttggcatctaaaaatggctgccatgctttgcttaccaaccattcggtcaacgccagcttcgccattgccgtttcggtagagtagaccgccgtcacggcagacaccgcagaagcaatggtcgcctcgcattgagtcagcagatcacgtaagtgagtgctcgctttacgcggcacaataccaccgaacagcatcagcgtatgacggaccaggctaatggctgccagcacctgttctttcgccgcatcgttgccgcgtacccacagttcttcatgatactgccattgcgctaacgccagctcgagcgccgcttccagcccctgttccacatcggcttttgccgcaacatgcaaaatggtggtcggtttgatttcacgcgccggattgccctgcgccagatgatagccacgcgccgctttgctcaggctgccctggcataatccggtttgcgataccagttggttcgccagtttcagcaccgcgcgcgtgtcgccgctaagcagttccagttccagctcacagataggttcagcaaattcacccgctttcacttccccctggtcgagggcgatttcaatttggctaccatcgaccgccaccagccatttttcgcgataaaaatcggtgctgaacagcggctgcacgcgggaggcgagatcggcgggcaattcgccgttcggccagacttccgtcggtaactgcgccaggtcgagcgtcggttcgctcaacgccacgttatattccgggcgctgatgtaagccgcctgtcactcttcctgcaactttcatggtcatctcatagcgaccgttttcgccacgaatacgtaagcccatatcgtgcccacgcagccagttatccggcgtttcgtagtaaatattcagcaactgcacggggtcatggtgctcgccgcccagcgtattgagatggtcacgcaacgcctcaacggcactgtgattaacaataaactttaattcgatttcctgagccatggcctttacttatcggttatgtcacataagtgacgatgaacggcgaacttaatgcgatcttttttgtcagtagatagtattttgcgccaaattgccatgcaacgggcaatttgacgggcgtaaaagtttgaagcagtggcaagacctgacacagaggattccgattgatgtcgaatgctttgcgtagcgacactgatgccactactatcgttccactttccatgacaataacgacagcctgatgccaaaattacgcctgatcggattaactttactcgcacttagcgcgactgccgtctcacacgctgaagaaacgcgctatgtttccgacgaactgaatacctgggtccgcagcggtccgggagatcattatcgcctcgtgggcacggttaacgccggcgaggaagtgaccttattacaaactgacgccaacaccaattatgcccaggtgaaagacagctctggccgtaccgcctggatcccgttgaaacaacttagcactgagccaagcctgcgctcccgtgtgccagatctggaaaatcaggtcaaaaccctgaccgataaactcaccaatatcgataacacctggaatcagcgcaccgcagaaatgcagcaaaaagtggcgcagagcgacagcgtgatcaacgggttaaaagaagaaaatcagaaactgaaaaacgagctgattgtcgcgcagaaaaaggtcgatgccgccagcgtacagctggatgacaaacagcgcaccatcatcatgcaatggtttatgtatggcggtggcgtgctggggcttggcttgctgctcggtctggtactgccgcacctgatcccaagccgcaaacgcaaagatcgctggatgaactaaatcgccttcttcgttgcactgtcttattattaggaattgtgtatttgacgaagggatgatggcgtgaagatttatctggtcggtggtgctgttcgggatgcattgttagggctaccggtcaaagacagagattgggtggtggtcggcagtacgccacaggagatgctcgacgcgggctaccagcaggtaggccgcgattttcctgtgtttctgcatccgcaaacgcatgaagagtatgcgctggcacgtaccgaacggaaatccggttccggttacaccggttttacttgctatgccgcaccggatgtcacgctggaagatgatcttaagcgtcgcgatctgaccattaatgcgctggcccaggacgataacggcgagattatcgacccgtacaacggtctgggcgatctgcaaaatcgtctgttgcgccatgtttcccccgcttttggcgaagatccgttacgcgtattgcgcgtggcgcgttttgctgcgcgttatgcccacctcggttttcgtattgccgatgaaactctggcgttgatgcgcgagatgacccatgcgggtgaactggaacacctgacgcctgaacgggtatggaaagagacggaaagcgccctcaccacccgcaatccacaggtgttcttccaggtactgcgcgattgcggcgcactgcgcgttttattcccggaaattgacgcactgtttggcgttccggcccctgccaagtggcatccggaaatcgatacgggtattcataccttaatgacgctctcaatggcggcgatgctgagtccgcaggtcgatgtccgtttcgcaactttatgccacgatctcggtaaagggctgacgccgccagaactctggccgcgtcatcatggtcatggcccggcgggtgttaagttagtggaacaactatgccagcgtctgcgcgtgccaaatgaaattcgcgatttagccagactggtggctgagtttcacgatctcatccacaccttcccaatgctgaacccaaaaaccatcgtcaaattatttgattccatcgatgcctggcgtaaaccgcagcgtgtcgagcaactggcgctgaccagcgaggctgacgtgcgcggcagaaccggttttgaatcagcggactacccgcaaggccgctggttgcgcgaagcctgggaagtggcgcagtcagtgccgacaaaagccgtcgttgaagcgggatttaaaggtgtggagattcgcgaggagctgacccgacggcggattgcggcggtagccagctggaaggaacaacgttgcccaaagcctgaatgagtattgggcattttgccggatgcggcgtaaacgccttatccggctacatgtcaacgacagttgtaggcctgataagacgcgcaagcgtcgcatcaggcgttgattgccggatgcggcgtgaacgccttattcggcctacgcaatcgttgacaacgccaagcatccgacactattcctcaattaaaagaacacgacatacaccgcagccgccacaataaagcgataaatggcgaacgggataaacgaaatgcgcttaatcaattgcaggaaggttttaatcgctatcagcgccaccacaaaagcggtgataaacccaacggcaaacatcgggatatcgccgcttgtcaggaagccccagcttttgtagagatcgagcgccgttgcgcccatcatcatcggcaccgccagcaggaacgaaaactcggaagcagcgtaacggctcacccccatcagcatcccacctgaaatggtcgccccggaacgggagaaacccggccacagcgccagacactggaaacagccaatcataaatgcctgacgataggtcatatcatcaagacccggcgcacgcggctctttcggcttcaggcattcggcggcaatcagcaacaaaccgccaacgaccagcgcatacatcacatttatcgggttaaacaatgacttaatcgtgtcgtggaacaacagccccaataccaccgccggaatcatccccagcaaaatgtggatcagcgttaaacgacctttgctttcaccttcgtgctgcaacgggcggccaaagtggatgccaatcaggccaaacagacgccgccagaacatcactactaccgccagaattgatcctaactggatcacaacttcaaaggttttcgccgtgtcgccctcaaaccccaacaagtgaccgacaataatcatatggcccgtgctggataccggcagaaattctgtcaatccttcgaccacacccaatattgccgctatcagcagcgagtgcatatcgctcatcaataaacccctaaattattaaaatgtaccgcttgtccgaactactgcgtatgaccaggttataaccgtttggtttaacaactgtaaaattaattattttctttcagattattgccacgctcaatgattacgccaacattcgccgcccgcgccactgcgcctggcttgctgagtttgatacgcacccacggcgagttgaagcgtgctaacagcagctccgccacctcttcagccacgcgttccaccagcgcaaaacgcgccccctcgacgtggctgaccaccgtttctgcaatgtcagcgtaactgaggcaatccgccacatcatcacttttcgccgctttacggttatcccacgccatttcgatatcgaacactaacttctgttcgatggtctgttcccagtcgtaaacaccaatagtggtgattaccgaaagttgctctataaatacaatatccatcacgtcctgcctgctttttggctaaccggataccacttccggcgaaatgtgcgtattatccacagattcatcgttgaacacgaattttcaaaacggaacagcttatgagtgcaatcgcgcctggaatgatcctcatcgcgtacctctgcggctccatttccagtgccattctggtttgccgcttgtgtgggctgcccgatccgcgaaccagcggctccggcaatccaggcgcaaccaatgtgttacgtatcggtggcaagggagcagccgtagcagtactgattttcgacgttctgaaaggaatgttgcccgtctggggcgcgtatgaattaggtgtcagccccttctggctaggcttaattgccatcgccgcctgtcttggacacatctggcccgttttcttcggatttaaaggaggaaaaggcgttgctaccgcttttggtgccatcgcacccattggctgggatctcaccggagtaatggcgggaacctggttactgaccgtgctattgagcggatactcgtcgctgggagcgattgtcagtgcactgattgctccgttttatgtctggtggtttaagccacaattcaccttcccggtttcgatgctctcttgcctgatcctgctgcgtcatcatgacaacatccaacgtctgtggcgtcgtcaggagacaaaaatctggacgaaattcaaaagaaagcgcgaaaaggatcccgagtgatttctggtggatctacatgacctgatagccttcatcgggcttgcccagccgttgctggcaccatgccgccagaaattccacgcagacacgtaatttcatgctgcgatagagcggctcccggtaaacagcccagatattggcgctttgtgcatactctggcaatacttgcaccagtttgccactctccagaaacggcaacacatcccactcggaacgcagcataatccctttgccctccagcgcccattgcagcacaatctcgccgctattggaggaaagatgcccgcttaccttcaccgattttttctcctgaccgttccccaactcccatattccatgggtcatatcgcgctctttggtcaccagacagtcatgacgacttaattcctgtagggattgtggctgcggatatttttgcagatactcaggtgctgcgcataatattcttttattttttgtcaaaagatgcgcggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaactgcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgagcgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattaccgaataagttgacagagattgtcgctaactttaccgccatgatttctacccgaatgcctgatgacgtggtggataaactaaaacagctaaaggatgccgaaacgtcgtcgatggggaaaattatctaccatacgatgttcgacaacatgcaaaaagcgattgacctgaatcgtcctgcctgtcaggacaccggggagattatgttcttcgttaaagtcggttcccgcttcccactgcttggcgagctgcaaagcatactcaaacaagccgtggaagaggcaaccgtcaaagcgccactacgtcacaatgcggtagaaatttttgacgaagtaaacaccggcaaaaataccggtagcggcgtaccgtgggtcacctgggacatcatccccgacaatgacgatgcggaaatcgaagtttacatggcaggcggcggctgcacgctacctggccgctcgaaagtgttaatgccgtcagaaggctacgaaggcgtggtgaaattcgtcttcgaaaatatctccaccctcgccgtaaacgcctgtccaccggtactggtgggcgtgggcatcgccacctcggtggaaaccgccgccgtactctcgcgtaaagccattttgcgcccgattggcagccgccatcccaatccaaaagcggcagaactggagctacgcctggaagaaggactcaaccgtctggggattggtccacaagggctgaccggcaacagttcagtgatgggcgtacatatcgaatctgccgcccgccatccgtcaaccatcggcgttgctgtttctaccggctgctgggcgcatcgtcgcggcacgctgctggttcatgccgatctctcctttgaaaatctgtctcacacccggagcgcgttatgaaaaagatcctgacaaccccgatcaaagctgaagatctgcaagatattcgcgtcggcgatgtgatctacctgaccggtacgctggtgacctgccgcgacgtttgtcaccgccgcttgatcgaactcaaacgtccgatcccttacgatctcaacggcaaagcgattttccacgctggccccatcgtgcgtaaaaacggcgataaatgggagatggtttccgttggcccgacaaccagtatgcgtatggaaagttttgaacgtgaatttatcgagcagaccggcgtgaaactggtggttggcaaaggtggtatggggccgctgaccgaagaaggctgccagaaattcaaggcgctacatgtgattttcccggcaggctgcgcggtgctggcagcaacccaggtagaagagattgaagaagtgcactggacagaactcgggatgccggagtcactgtgggtctgccgggtcaaagagttcggcccgctgattgtctctattgatacccacggcaacaacctgatagccgaaaacaaaaagctattcgccgaacgccgcgatcccatcgtggaagagatctgcgagcacgtccattacatcaaataaccctcccggagaggctcaccccctctcctttttcgcaggcataacacgatgaaaccttccactgaatggtggcgataccttgcgccgctggcggtcatcgccattattgctctaattccggttcccgcagggctggagagtcatacctggctttactttgccgtttttactggcgtgatcgttggactgatcctcgaacccgtgccgggtgccgtggtggcgatggtgggtatatccatcatcgccatactctctccctggctgctgttcagcccggagcagctcgctcagccaggctttaaattcactgcaaaatccctctcgtgggccgtttccggtttttctaattcggttatctggctgattttcgccgcctttatgtttggcacaggctatgaaaaaaccgggcttggacgccgcattgcgctgattctggtgaaaaagatggggcatcgtacgctgtttctcggctatgcggtgatgttctccgagctgatcctggcacctgtaacaccgtccaactcggcgcgtggtgcggggattatctatcccatcatccgtaacctgccaccgctctatcaatcacaaccaaacgacagcagttcacgcagcattggctcgtacatcatgtggatggggattgttgccgactgcgtgaccagcgccattttcctgacggcgatggcaccaaacttgctgttaattggactgatgaaaagtgcatctcacgccacgctgagttggggcgactggttcctcgggatgttgccgctcagcattttactggttctgctggttccctggatggcttacgtgctgtacccaccggtactgaagtctggtgatcaggtgccgcgctgggcagagacggaactgcaggcaatgggcccgctctgttctcgtgaaaaacggatgctggggctgatggtaggcgcgctggtgctgtggattttcggcggtgattatattgatgctgcgatggttggttacagcgtagtggcactgatgctgcttctgcgcattatctgctgggacgacattgtcagtaataaagcggcgtggaacgttttcttctggctggcctcgcttatcaccctcgctaccggactcaacaacaccggttttattagctggtttggcaaactgttagcaggcagcttaagtggttattcgccgacgatggtgatggtggcattgattgtggtgttttatctactgcgctactttttcgccagcgccacggcgtatacctccgccctcgcaccgatgatgatcgccgccgcgctggcgatgccggaaatcccgctgccggtgttctgcctgatggttggcgcggcaattggtctggggagcattcttacaccatacgccaccggacccagtccgatttactacggtagtggttatctgccaacggcggattactggcgactgggggcgatttttgggctgatattcctcgtattgctggtgattaccggcttactgtggatgcccgtggtgttgctttaagtaaggacggtgccggaaattgctctccggcacccgatagttttacgcggccggtaactccgccagcggccagcgcggacgcacgctaacgccgagatccgccgtcgcgcctgctttaaaccgcaccattccggcataggcgatcatcgcgccgttatcagtacaaaactccggacgcgcgtagaacacttcgccgcggcgttttttcatcatttcagccagcttcgcccgtaacgtacggttagcactcacgccgcctgccatgaccagtcgcttaaagccagtctgatccaacgctcgcttgcacttaatcatcagcgtatcgaccaccgcatcttcaaaggcgcgggcgatatcagcacgcgtctggtcgtcggtgccgttgtcacgaatggtatttgccgcgaaggttttcagaccggagaaactgaaatccagccccggacggtcggtcatcggacgcgggaagacaaagcgcccggcagtaccctgagccgccattttcgacagtaacggtccgccaggataatccagccccagcagcttcgcggttttatcaaacgcttcaccggcggcatcatcgatagactcgccgagcagctcgtactgaccaatgccagtcacgctgattaactgcgtatgaccgccggacaccagcagcgcgacaaacggaaattccggcgggttatcttccagcatcggcgctaacagatgcccttccatatggtgtaccgggattgccggaacgttccaggcaaacgccagagaacgccccacggttgcgccaaccagcagtgcgccgactaatccagggcctgcggtataggccacagcatcaatgtcttttgccgttaagccagactcctttagcgccgcctggatcaacggtacggttttgcgcacgtgatcgcgggaggccagttcaggcacgacgccgccgtagtcagcgtgcaatttcacctgactatacaattggttggctaacaaacctttttcatcgtcgtaaatggcgatgccggtttcatcgcaggaagtttcaatacccagtacacgcatgacttgttttacctcgctttattaccgcgcagtgtaggaccaatgcgggttgatgtaaaactttgttcgcccccggagaaagcctcgtgtatactcctcacccttataaaagtccctttcaaaaaggccgcggtgctttacaaagcagcagcaattgcagtaaaattccgcaccattttgaaataagctggcgttgatgccagcggcaaaccgaattaatcaaaggtgagaggcacatgccggtaattaaagtacgtgaaaacgagccgttcgacgtagctctgcgtcgcttcaagcgttcctgcgaaaaagcaggtgttctggcggaagttcgtcgtcgtgagttctatgaaaaaccgactaccgaacgtaagcgcgctaaagcttctgcagtgaaacgtcacgcgaagaaactggctcgcgaaaacgcacgccgcactcgtctgtactaattccccgagagcgttgctctccgatcagaccgagttgtagttgtaaggccgtgcttccgaaaggaatgcgcggcttattttcgtttatgaattgctaaaaatcggggcctatggctggacgaatcccacgcgtattcattaatgatctgctggcacgcactgacatcgtcgatctgatcgatgcccgtgtgaagctgaaaaagcagggcaagaatttccacgcgtgttgtccattccacaacgagaaaaccccgtccttcaccgttaacggtgagaaacagttttaccactgctttggatgtggcgcgcacggcaacgcgatcgacttcctgatgaactacgacaagctcgagttcgtcgaaacggtcgaagagctggcagcaatgcacaatcttgaagtgccatttgaagcaggcagcggccccagccagatcgagcgccatcagaggcaaacgctttatcagttgatggacggtctgaatacgttttaccaacaatctttacaacaacctgttgccacgtctgcgcgccagtatctggaaaaacgcggattaagccacgaggttatcgctcgctttgcgattggttttgcgccccccggctgggacaacgtcctgaagcggtttggcggcaatccagaaaatcgccagtcattgattgatgcggggatgttggtcactaacgatcagggacgcagttacgatcgtttccgcgagcgggtgatgttccccattcgcgataaacgcggtcgggtgattggttttggcgggcgcgtgctgggcaacgatacccccaaatacctgaactcgccggaaacagacattttccataaaggccgccagctttacggtctttatgaagcgcagcaggataacgctgaacccaatcgtctgcttgtggtcgaaggctatatggacgtggtggcgctggcgcaatacggcattaattacgccgttgcgtcgttaggtacgtcaaccaccgccgatcacatacaactgttgttccgcgcgaccaacaatgtcatttgctgttatgacggcgaccgtgcaggccgcgatgccgcctggcgagcgctggaaacggcgctgccttacatgacagacggccgtcagctacgctttatgtttttgcctgatgacgaagaccctgacacgctggtacgaaaagaaggtaaagaagcgtttgaagcgcggatggagcaggcgatgccactctccgcatttctgtttaacagtctgatgccgcaagttgatctgagtacccctgacgggcgcgcacgtttgagtacgctggcactgccattgatatcgcaagtgccgggcgaaacgctgcgaatatatcttcgtcaggaattaggcaacaaattaggcatacttgatgacagccagcttgaacgattaatgccaaaagcggcagagagcggcgtttctcgccctgttccgcagctaaaacgcacgaccatgcgtatacttatagggttgctggtgcaaaatccagaattagcgacgttggtcccgccgcttgagaatctggatgaaaataagctccctggacttggcttattcagagaactggtcaacacttgtctctcccagccaggtctgaccaccgggcaacttttagagcactatcgtggtacaaataatgctgccacccttgaaaaactgtcgatgtgggacgatatagcagataagaatattgctgagcaaaccttcaccgactcactcaaccatatgtttgattcgctgcttgaactgcgccaggaagagttaatcgctcgtgagcgcacgcatggtttaagcaacgaagaacgcctggagctctggacattaaaccaggagctggcgaaaaagtgatttaacggcttaagtgccgaagagcgatcgggaagcccccgacagccgcactgagaggcagcggcaaatatataagtacgccctcgtaattatcgttggcggtaaacaaccgttggatttcagcgttaacggctgaaggacatcgggtcaatcgcccaacaccaacctcatgaaataagtgtggataccgtcttatggagcaaaacccgcagtcacagctgaaacttcttgtcacccgtggtaaggagcaaggctatctgacctatgccgaggtcaatgaccatctgccggaagatatcgtcgattcagatcagatcgaagacatcatccaaatgatcaacgacatgggcattcaggtgatggaagaagcaccggatgccgatgatctgatgctggctgaaaacaccgcggacgaagatgctgccgaagccgccgcgcaggtgctttccagcgtggaatctgaaatcgggcgcacgactgacccggtacgcatgtacatgcgtgaaatgggcaccgttgaactgttgacccgcgaaggcgaaattgacatcgctaagcgtattgaagacgggatcaaccaggttcaatgctccgttgctgaatatccggaagcgatcacctatctgctggaacagtacgatcgtgttgaagcagaagaagcgcgtctgtccgatctgatcaccggctttgttgacccgaacgcagaagaagatctggcacctaccgccactcacgtcggttctgagctttcccaggaagatctggacgatgacgaagatgaagacgaagaagatggcgatgacgacagcgccgatgatgacaacagcatcgacccggaactggctcgcgaaaaatttgcggaactacgcgctcagtacgttgtaacgcgtgacaccatcaaagcgaaaggtcgcagtcacgctaccgctcaggaagagatcctgaaactgtctgaagtattcaaacagttccgcctggtgccgaagcagtttgactacctggtcaacagcatgcgcgtcatgatggaccgcgttcgtacgcaagaacgtctgatcatgaagctctgcgttgagcagtgcaaaatgccgaagaaaaacttcattaccctgtttaccggcaacgaaaccagcgatacctggttcaacgcggcaattgcgatgaacaagccgtggtcggaaaaactgcacgatgtctctgaagaagtgcatcgcgccctgcaaaaactgcagcagattgaagaagaaaccggcctgaccatcgagcaggttaaagatatcaaccgtcgtatgtccatcggtgaagcgaaagcccgccgtgcgaagaaagagatggttgaagcgaacttacgtctggttatttctatcgctaagaaatacaccaaccgtggcttgcagttccttgacctgattcaggaaggcaacatcggtctgatgaaagcggttgataaattcgaataccgccgtggttacaagttctccacctacgcaacctggtggatccgtcaggcgatcacccgctctatcgcggatcaggcgcgcaccatccgtattccggtgcatatgattgagaccatcaacaagctcaaccgtatttctcgccagatgctgcaagagatgggccgtgaaccgacgccggaagaactggctgaacgtatgctgatgccggaagacaagatccgcaaagtgctgaagatcgccaaagagccaatctccatggaaacgccgatcggtgatgatgaagattcgcatctgggggatttcatcgaggataccaccctcgagctgccgctggattctgcgaccaccgaaagcctgcgtgcggcaacgcacgacgtgctggctggcctgaccgcgcgtgaagcgaaagttctgcgtatgcgtttcggtatcgatatgaacaccgaccacacgctggaagaagtgggtaaacagttcgacgttacccgcgaacgtatccgtcagatcgaagcgaaggcgctgcgcaaactgcgtcacccgagccgttctgaagtgttgcgtagcttcctggacgattaatcggtaggccggatcaggcgttacgccgcacccggcactagtccctctgcacaaacgccaccttttcggtggcgttttttatcgcccacgcactaccagcgcctggtccagctcgcgatacgcttcaaccagtttctctagtgaaacgcgacttaaaccgctgggatttggcagcacccaaatctgcgtcgaaccaatggtgagcgtttgtttcccccactgtgcaccgcgctggctgaatccctgttcatatgcttgtttgcccagaatcgccaacgcctgcggctgataatcctcaattttttcaatcaacttacgcccacctgcgtgcaactcctgctttgaaacttcactggcttgcaccgttggcctgtcaaccagtttggtgacgccacaacgataatccagcagatgctgtgcctcctgcggcttcaactgacggtcggtaaacccggcctgatatatcaccttccagaagcgatttgccggatgagcaaagggaaaaccagtcccggcggatgaaagcccagggttgataccgcaaaacacgacccgtaaccctggagccaaaatatcctcaaccatatttactcctttctaacatcaccaggaaaagtataacggattgaaaatacattgtttataaaaacagcaggcgcgcggtaatggctggattgcgacacggagttactttataatccgctaccatggccccttagctcagtggttagagcaggcgactcataatcgcttggtcgctggttcaagtccagcaggggccaccagatatagcaaaggctgacgagaaatcgtcagcctttttcttttacatatcagttactttgcgtgccagtaggccgctgcacgaacccgctgtgggtcaaactgttccgtttcaaagcggcggcttaaattcttaacgactttgccttcgccggttatccagatgaagtaatcatcggcagggatttgcatctgcgccagacgcgcatctaccgcctgctcatcatgtgccagccattcgatattaaaaccatcaaggtgcgcgagataatcctgacaggcgttatcccgcacgctaaccagcacgctaacttgcggtttaacggcaagtttgctcaacgtttccaggcggcggcgcaatgcgggcattccggattcatcgcagacatacagctgatacgcgtaatcttccggcaccaccagcgaaccgcgcggacctgccaccgtgagtttatcgcccggttgggcctgcattgcccagctactggcgacgccgtcttcgtgaataaagaaatcaatcgccagttcatggcgtagttcgtcatacaacggcgtatagtcacgcgacggtgggcgtggtccttccggccagacgatgccctcttccgttaccgttggcggcacaaagtgagcgtcaggttgaggaaagaagagtttgctgtgatcgtcaaagccgcgcgatgtaaaaccgtccagcgcctcgccgccgaggacaatgcgctgaaaaccggcgctgatgcgctcaacgcgtaacacagtcagttcacggaagcgcagatcattgcgaacgcgctgcgggtagcggggggagttattcattgttatcgccttcgtgatggtaattagatatatctaaataaaactcgcaaatgataatgattgttaatcatgataaatgcaagcgatttgtagaactgatatatctgtagtctgataagacgcgcaacctcttatcaagcatcattgctcaatgccggatgcggcgtgaacgccttatccggcctacatgttgagtaaacctgcgtttaaaaatcatttttgtacttgcagtaatacttatatcagatataaattagatatatctaattaagcaaaaggaggctgatatgagccatcatcacgaagggtgttgtaaacatgaaggccagccacgccatgagggctgctgcaaaggtgagaagtcagaacacgagcactgcggacacggtcaccagcatgaacacggtcaatgctgcggtggtcgccacggtcgcggcggcggtcgtcggcaacgtttctttggtcacggtgaattgcgtctggtgattctggatattctctcgcgcgatgacagccacggttacgaattgattaaagcgattgagaatctaacccaggggaattacaccccaagcccgggcgtcatctacccaacgctggattttctgcaggagcagtcgctgattaccatccgcgaagaggaaggaggtaagaagcagattgcgctgaccgaacaaggcgcgcagtggctggaagaaaaccgcgaacaggtggagatgattgaagaacgcatcaaagcgcgttgcgttggcgcggcgctgcgccagaacccgcaaatgaagcgggcgctggataattttaaagcggtgctggatttacgcgtcaaccagagcgatatcagtgatgcacaaataaaaaagatcattgcggtgatcgaccgcgccgcttttgatattacgcaactggattaatcgccgcatccgccagtggcgcggtgcaattgccggatgcgacgcttgacgcgccttatccggcctacacccgctacacaccccgcaggcctgataagatgcgccagcatcgcatcaggcattgtgctccaaccgccggatccggcataccgattaatgcagtaccgtcaccgcgtcttccagtcggctggcgcggtgtttcaccatcgccgacacctgcgcactctcttccaccagctcggcatttttctgggtgatcaggttaagctcatccactgcacgggtcaggctggaaagcccatcggcctgttccagcgttgaatggctaatctgggcgatcaactgggtgacgtttttcacctgtgccacaatatcttccatcgtccgtccggcggcgtgtacctgctgcgaaccggattgcaccttatcagcactggcatcaatcagcttgcgaatatcgttggcagcattagcgctgcggctggctaaatgacgcacttcccctgccaccactgcaaaacctttgccctgttcgccggcacgcgccgcttccaccgccgcattcagggccagaatattggtctgaaacgcaatatcgttaatcagcgaagtaatggtgccaatgcgctgggtactgtcggcgatatcgtccattgtcttgatcaccgtggtcatcgcctccccaccctgcactgccgcattactggcagtgattgacagtttatcggcagccgacgccgtggcagagttctgtttcaccgacgccgccatttggttcatggtcgccaccgtttgctgaacgttatcaactgtctgctgggtatgttcgttcagttcatcggtgcctttcgccagcgtctcactgccatttctgacactggacacctggcttgagacatcgttaattagccaacggcacatcaggccaagttgccctaccgcacgtaatgtcagccccagctcatcgctgcgattcagatgctcaacactattacgttctccggtcgccaccttcagtgcctgatgggcaacattttctatcgggcgcacaatctgccattcaaaacaggcgcttgccaacaataccactaacgcacagaggatatacgtcaccaccggggcagcaacaaaccaaagcatggccgccagcaagataaacatcagggtcatcactccacgcgcccgccagcgaagcggtaatgaaggcagtttacccagccagcctttacgcaccaccaggcctttatgaatacgcttactggtacgtccggcgttcaacgctttgtacagcggctccaccgccgcgatctcttcatccgtcgcccgggtacgaatcgacatatagccactgatttttccctcgcgcaccatcggtaccgcattggcccgcacccaataatggtcaccatttttgcggcgatttttcacgatgccgctccagggctccccttttttcagggtgaaccacatatccgcaaacgccgcttttggcatatccgggtgacgcaccatgttgtgcggctgcccttgtaactcttgcaaggtatagccgctcacctgcacaaaagtgtcattagcatgagtgatatagctttgcagatcggtagtggacatcagagtggtatcgtccgccagcggggtattttgctgggtgacatacggatgagaagacatgttcgcgtcctgtgcaggttatatggttgttaacttcttgtcagagtttatgtcggccccgctgcggttatctttaaccgattaatttgatttagatcgcaatttgcgatttaaacacaaatctaattccttgatttaaaatactttcactctgttactatacgaaaacgttaattatcttgcccaaaaatcaggcaattattgccctgaaaacgtgcatttgcgcagcaatcatcaaatccatacccgacaaaaaccgtgcaaaataacaacaaatgttaacagatagcattaaatattgcacaaatgataaccgaatttgtgtttatcccgattttcgcgatcgcagccggagtggcgcaatccctgcaatacttaaatcggtatcatgtgatacgcgagcctccggagcatattttgaacaggttaccttcgagcgcatcggctttagcgtgcagcgcccacgccctgaatctcattgagaagcgaacgctggatcatgaggagatgaaagcacttaaccgagaggtgattaaatacttcaaagagcatgtcaatccggggtttttagagtatcgcaaatctgttaccgccggcggggattacggagccgtagagtggcaagcgggaagtttaaatacgcttgtcgacacccagggccaggagtttatcgactgcctgggaggttttggaattttcaacgtggggcaccgtaatccagttgtggtttccgccgtacagaatcaacttgcgaaacaaccgctgcacagccaggagctgctcgatccgttacgggcgatgttggcgaaaacccttgctgcgctaacgcccggtaaactgaaatacagcttcttctgtaatagcggcaccgagtccgttgaagcagcgctgaagctggcgaaagcttaccagtcaccgcgcggcaagtttacttttattgccaccagcggcgcgttccacggtaaatcacttggcgcgctgtcggccacggcgaaatcgaccttccgcaaaccgtttatgccgttactgccgggcttccgtcatgtgccgtttggcaatatcgaagccatgcgcacggctcttaacgagtgcaaaaaaaccggtgatgatgtggctgcggtgatcctcgaaccgattcagggtgaaggtggcgtaattctgccgccgccgggctatctcaccgccgtacgtaagctatgcgatgagttcggcgcactgatgatcctcgatgaagtacaaacgggcatggggcgcacgggcaagatgttcgcctgcgagcatgagaacgtacagccggatatcctctgccttgccaaagcgctcggcggcggcgtgatgccgattggcgcgaccatcgccactgaagaggtgttttcagttctgttcgacaacccattcctgcataccaccacctttggcggcaacccgctggcctgtgcggcggcgctggcgaccatcaatgtgttgctggagcagaacttaccggctcaggctgagcaaaaaggcgatatgttgctggacggtttccgtcaactggcgcgggaatatcccgatctggtacaggaagcgcgtggtaaagggatgttgatggcgattgagtttgttgataacgaaatcggctataactttgccagcgagatgttccgccagcgcgtactggtggccggaacgctcaataacgccaaaacgatccgcattgaaccgccactgacactgaccattgaacagtgtgaactggtgatcaaagcggcgcgtaaggcgctggcggccatgcgagtaagtgtcgaagaagcgtaatatcaaatcggatggcgatacgacgtcgccatccgatctttttatacgacgcgtacgcccgcaggcatcatccgctccggcgttaacagcacgctttcactgccgtcatcggtttccgcacacaacagcatgcattccgacgtttcaccacgcattttcgctttttgcagattgcataagaccaccaccgtttttcccatcaactcttcttcgctgtagtacggcaccaggctggtcacggtttgcagtgttttttcccccacatcaacctgtacgatgtacagcttgtcggcgttttcatggcgtttcacttccacaatctttccgacgcgcatttccagacgtgcaaaatcagcgtaagccacggtttccattgcttcctcccttcgagtaaaattttactaaactatagcaaaagtttttctcaatcctgtaggctaaaaatggagaatgcaggcgtgatcacattcgtgagccgctgtgttaccgttacagcgtcaaagaaacgcgctttatttactgaaaacaggtgacccaataagcacttcctctacaatggaagcgcacatcagggaaagtaaaaaaggtaaacatggcaacactaaaagacatcgcaatcgaagctggcgtatccctggcgacagtatccagggtcttaaatgacgatccgacattgaatgtgaaagaagagacgaaacatcgcattctcgagatcgccgaaaagctggagtacaagaccagtagcgcccgtaaactacagacaggcgcagtcaaccaacaccatattctggctatctacagctaccagcaggagctggagatcaacgatccttactatctggcgatccgccacggcattgaaacccagtgcgaaaagctgggcatcgagctcaccaactgttatgaacacagcggattaccagacattaaaaacgtcaccggtattttaattgtcggcaaacccacgcccgccctgcgcgccgctgccagcgcgttgaccgacaatatctgttttatcgactttcacgaacccggcagcggttacgatgcggtggatatcgatctggcacgcatcagtaaagaaatcatcgacttctatatcaaccagggcgttaatcgcattggttttattggcggtgaagatgagcctggcaaggcggatattcgtgaggtcgcctttgtggaatatggccgactgaaacaagtggtacgcgaagaggatatctggcgcggcggtttttccagttcgtcgggctatgaactggcaaaacagatgctgtcgcgggaagactatccgaaggcactgtttgttgcttccgattccattgctatcggcgtactgcgggcaattcatgaacgtggcctgaacatcccacaggatatttcgcttatcagcgttaacgatatccccaccgcgcgatttacctttccgccgctctccaccgtgcgcatccattccgagatgatgggaagtcagggcgttaacctggtgtatgaaaaagcccgcgatggtcgcgcgctgccgctgttagtcttcgttcccagcaaattaaaactgcgcggcacgacccgttaaatccccttacacactgtccggcagtcgtttttgccggacagtgctgccgtttattttcgtgatccagttaaagtaaatgcatttaactgctactttttagtaaaaattttactaaactccccagcaattacacaaactaccatcaccatgaatggttccgatttctctctaccgggaggccctatgaatcgctgggaaaacattcagctcacccacgaaaaccgacttgcgccgcgtgcgtactttttttcatatgattctgttgcacaggcgcgtacctttgcccgcgaaaccagcagcctgtttctgcccttaagcggtcagtggaatttccatttttttgaccacccgctgcaagtgcctgaagccttcacctctgagttaatggctgactgggggcatattaccgtccccgccatgtggcaaatggaaggtcacggcaaactgcaatataccgacgaaggttttccgttccccatcgatgtgccgtttgtccccagcgataacccaaccggtgcctatcaacgtattttcaccctcagcgacggctggcagggtaaacagacgctgattaaatttgacggcgtcgaaacctattttgaagtctatgttaacggtcagtatgtgggtttcagcaagggcagtcgcctgaccgcagagtttgacatcagcgcgatggttaaaaccggcgacaacctgttgtgtgtgcgcgtgatgcagtgggcggactctacctacgtggaagaccaggatatgtggtggtcggcggggatcttccgcgatgtttatctggtcggaaaacacctaacgcatattaacgatttcactgtgcgtaccgactttgacgaagcctattgcgatgccacgctttcctacgaagtggtgctggaaaatctcgcagcctcccctgtcgtaacgacgctggaatataccctgtttgatggcgaacgcgtggtgcacagcagcaccattgatcatttggcaattgaaaaactgaccagcgccagctttgcttttactgtcgaacagccccagcaatggtcagcagaatccccttatctttaccatctggtcatgacgctgaaagacgccgacggcaacgttctggaagtggtaccacaacgcgttggcttccgtgatatcaaagtgcgcgacggtctgttctggatcaataaccgttatgtgatgctgcacggcgtcaaccgtcacgacaacgatcatcgcaaaggccgcgccgttggaatggatcgcgtcgagaaagatctccagttgatgaagcagcacaatatcaactccgtgcgtaccgctcactacccgaacgatccgcgtttttacgaactgtgtgatatctacggcttgtttgtgatggcggaaaccgacgtcgaatcgcacggctttgctaatgtcggcgatatcagccgtattaccgacgatccgcagtgggaaaaagtctacgtcgagcgcattgttcgccatattcacgcgcagaaaaaccatccgtcgatcatcatctggtcgctgggcaatgaatccggctatggctgtaacatccgcgcgatgtaccatgcggctaaagcgctggatgacacgcgactggtgcattacgaagaagatcgcgatgctgaagtggtcgatattatttccaccatgtacacccgcgtgccgctgatgaatgagtttggtgaatacccgcatccgaagccgcgcatcatctgtgaatatgctcatgcgatggggaacggaccgggcgggctgacggagtaccagaacgtcttctataagcacgattgtattcagggacattatgtctgggaatggtgcgaccacgggatccaggcgcaggatgacaacggcaatgtctggtataaattcggcggcgactacggcgactatcccaacaactataacttctgtcttgatggtttgatctattccgatcagacgccgggaccaggcctgaaagagtacaaacaggttatcgcgccggtaaaaatccacgcgctggatctgactcgcggcgagctgaaagtcgaaaataaactgtggtttaccacgcttgatgactacaccctgcacgcagaggtgcgcgccgaaggtgaaacgctcgcaacgcagcagattaaactgcgcgacgttgcgccgaacagcgaagcccccttgcagatcacgctgccgcagctggacgcccgcgaagcgttcctcaacattacggtgaccaaagattcccgcacccgctacagcgaagccgggcattctatcgccacttatcagttcccgctgaaggaaaacaccgcgcagccagtgcctttcgcaccaaataatgcgcgtccgctgacgctggaagacgatcgtttgagctgcaccgttcgcggctacaacttcgcgatcaccttctcaaaaatgagtggcaaaccgacatcctggcaggtaaatggcgagtcgctgctgactcgcgagccaaagatcaacttcttcaagccgatgatcgacaaccacaagcaggagtacgaagggctgtggcagccgaatcatttgcagatcatgcaggaacatctgcgcgactttgccgtagaacagagcgatggtgaagtgttgatcatcagccgcacggttatagcaccgccggtgtttgacttcgggatgcgctgcacctacatctggcgcatcgctgccgatggccaggttaacgtggcgctttccggcgagcgttacggcgactatccgcacatcattccgtgcatcggtttcaccatggggattaacggcgaatacgatcaggtggcgtattacggtcgtggaccgggcgaaaactacgccgacagccagcaggctaacatcatcgatatctggcgcagcaccgtcgatgccatgttcgagaactatcccttcccgcagaacaacggcaaccgtcagcatgtccgctggacggcactgactaaccgccacggcaacggtctgctggtggttccgcagcgcccaattaacttcagcgcctggcactatccccaggaaaacatccacgctgcccagcactgtaacgagctgcagcgcagtgatgacatcaccctgaatctcgaccaccagctgcttggcctcggctccaactcctggggcagcgaggtgctggactcctggcgcgtctggttccgtgacttcagctacggctttacgttgctgccggtttctggcggagaagctaccgcgcaaagcctggcgtcgtatgagttcggcgcagggttcttttccacaaatttgcacagcgagaataagcaatgaggatcatcgataacttagaacagttccgccagatttacgcctctggtaagaagtggcaacgctgcgttgaagcgattgaaaatatcgacaacattcagcctggcgtcgcccactccatcggtgactcattgacttaccgcgtggagacagactccgcgaccgatgcgctatttaccgggcatcgacgctattttgaagtgcattactacctgcaagggcagcaaaaaattgaatatgcgccgaaagagacattacaggtagtggaatattatcgtgacgaaactgaccgcgaatatttaaaaggctgcggagaaaccgtagaggtccacgaagggcaaatcgttatttgcgatatccatgaagcatatcggtttatctgcaataacgcggtcaaaaaagtggttctcaaagtcaccatcgaagatggttatttccataacaaataacaactacggcggcaaaaggagtttgccgccaccgctaccctacacattttcggagatgtgttatgtctgataccaaacgtaatacaatcggcaaattcggcttgctctcgctgacttttgccgccgtttacagctttaacaacgttatcaataataatattgagcttggactggcctcggcaccgatgtttttcctcgcgacgattttttattttattcccttctgtctgatcatcgcagaatttgtttcgttaaataaaaactcagaagccggtgtctacgcgtgggtaaaaagttcgctgggcgggcgttgggcatttattactgcctatacctactggttcgtaaacctgttctttttcacctcgctgttgccgcgcgttattgcttatgcttcgtatgccttcctcggctacgaatatattatgacgccggttgccaccaccattatcagtatggtgctgttcgccttctccacctgggtttccaccaacggggcgaaaatgttggggccaattacctccgtcacttcaacgctgatgctgctgttaacgctctcctacattttactggcaggtacggcgctggttggcggcgtacagcctgctgaccccatcaccgttgacgcgatgatcccgaacttcaactgggcgttcctcggcgttaccacctggatctttatggccgcaggtggcgcggagtccgtcgcggtgtacgttaacgacgtcaaaggcggttcgaaatcgttcgttaaagtgatcatcctcgccgggatttttatcggcgtactgtattccgtctcctcggtgctgattaacgtcttcgtcagcagcaaagagttgaaatttaccggcggatcggtgcaggtattccacggcatggcggcgtattttggtctaccggaagcgttgatgaatcgctttgtcggtctggtgtcctttaccgcgatgttcggttccctgctgatgtggaccgcaacgccggtgaaaattttcttctccgaaatcccggaaggcatctttggtaagaaaaccgtcgaactgaacgaaaacggcgttccggcgcgcgcagcgtggatccagttcctgatcgtcatcccgctgatgattatcccgatgctcggttccaataccgtgcaggatctgatgaatactattattaatatgaccgccgcagcgtccatgcttccgccgttattcatcatgctggcttacctgaatttacgcgccaaattagatcacctgccacgcgatttccgtatgggctcccgccgcaccggtattatcgttgtttcaatgctgattgcgatatttgccgtagggtttgtcgcttcgacattcccgactggcgcgaatattctgaccatcattttttataacgtcggcggtattgttatcttccttggctttgcgtggtggaaatacagtaaatatataaagggattaacggctgaagagcgccatattgaagcgacgccagccagcaatgttgattaagcagaataataaaaaatgagcaggcattttccctcttcctggatgaggagagggaaaatagtttctgcctttatatttttataattacaacgataaaaggctgtactttttctttagctcatggattaacacaatgaaattaatcactgcaccatgcagagcattacttgctctgccgttttgctacgccttttctgcggcaggagaagaagcacgtccggcagaacatgacgacacaaaaacacctgcaattacctcgacatcttctccttcatttcgtttttacggcgaattaggggttggtggatatatggatttagagggtgagaataaacataaatacagcgacggcacctatattgaaggtggcctggagatgaagtacggctcctggttcggcctgatttacggcgaaggctggaccgtgcaggccgaccacgacggcaatgcctgggtgccagaccatagctggggtggtttcgagggaggaattaaccgtttctatggcggttatcgtaccaatgatggcaccgaaatcatgctcagtctgcgtcaggattcctcgctggatgacctgcaatggtggggcgacttcacccccgatctgggctacgtcattcccaatacccgcgacattatgaccgcgctgaaggtgcagaacttaagcggcaactttcgttatagcgtcaccgccacacctgccggacatcatgacgaaagcaaagcctggctacattttggcaagtacgatcgctatgacgacaaatacacctatccggcaatgatgaacggttacatccagtatgaccttgccgaaggcatcacctggatgaacggtctggaaatcaccgacggcacaggacagctctatctcacgggcctgctaactcctaactttgccgctcgcgcctggcaccataccggacgcgccgacgggctggacgtaccgggaagtgaaagtgggatgatggtgagcgccatgtatgaagcgttaaagggcgtttatctctccaccgcttacacctacgccaaacatcgccctgaccacgctgacgatgaaaccacctctttcatgcagtttggtatctggtacgaatacggcggcggacgtttcgccacggcttttgatagccgcttctacatgaaaaatgcctctcacgatcccagcgaccaaatcttcctgatgcaatatttctactggtaataaggactgtaatttcatgaaaataaaaactattttaacgccagtaacctgcgctctgctgataagtttttccgcccatgccgctaacgccgacaattataaaaacgtgattaaccgtactggcgcgccgcagtacatgaaggattacgattacgacgatcaccagcgttttaatccgtttttcgatctcggagcctggcatggtcatctgttgccagacggccctaacaccatgggcggctttccgggcgttgcgctgctgacggaagagtacatcaactttatggccagcaatttcgaccgcctgaccgtctggcaggacggcaagaaagtcgactttacgctggaggcatacagtattcccggtgcgctggtgcaaaaactgacagcaaaagatgtgcaagtcgaaatgactctgcgcttcgccacgccgcgcacgtcactactggaaaccaaaatcaccagcaataaaccgctggatctggtgtgggacggcgaactgctggaaaaactggaagcgaaagaagggaaaccgctttccgataaaaccattgctggcgaataccctgactatcagcgcaaaatcagcgccacccgtgatggcctgaaagtcacctttggcaaagtgcgcgccacctgggatctgctgacctccggcgaatcggaatatcaggtgcataaatccctgccggtgcagactgaaatcaacggtaatcgctttaccagtaaggcgcatatcaacggttcgacgacgctctataccacctattcccatctgctgaccgctcaggaagttagcaaagagcaaatgcagatccgcgatattctggcgcgtccggcgttttatctcaccgcctcgcagcaacgctgggaagagtatctgaagaaagggttaaccaatccggatgcgacgccggaacagacgcgcgtcgcggtgaaagcgatcgaaacgctcaacggtaactggcgctcgcctggcggcgcggtgaaatacaacaccgtcacgccgtcggtgaccgggcgctggttctccggcaatcagacctggccgtgggatacctggaagcaggcgtttgcgatggcgcatttcaatccggacatcgccaaagagaatatccgcgcggtcttctcctggcagatccagcccggcgacagcgtgcgtccgcaggatgtgggctttgtccccgacctgatagcgtggaaccttagccccgagcgtggtggcgatggcggcaactggaacgaacgtaataccaaacccagccttgccgcctggtcggtgatggaagtgtataacgtcacccaggataaaacctggctggcagagctgtacccgaaactggtggcctatcacgactggtggttacgtaaccgcgatcacaacggcaacggcgtgccggaatatggcgcgacccgcgacaaagcccacaacactgagagcggcgagatgctgtttacggtgaaaaaaggcgataaagaagagacgcagtctgggctgaacaactacgcccgcgtggtggagaaaggccagtacgacagtctggaaattccggcacaggttgctgcatcgtgggaatcgggccgtgatgacgccgccgtctttggttttatcgacaaagaacagttggataaatatgtcgctaatggcggcaaacgtagcgactggacggtgaaattcgccgaaaaccgcagtcaggacggaacgttgctgggctactcgctattgcaggagtcggtggatcaggccagctatatgtacagcgataaccattatctggcggagatggcgaccatcctcggtaagccagaagaggccaaacgctatcgccagttggcacagcagctcgcggactacatcaacacctgtatgttcgacccgactacccagttctactatgacgtacgtattgaagataaaccactggcgaacggctgcgcgggcaaaccgattgttgagcgcggtaaagggccggaaggctggtcgccgctgtttaacggtgcggcaacgcaggccaatgccgacgcggtggtgaaggtgatgctcgatcctaaagagttcaacacctttgtcccgctgggaacggcggcgttaaccaatccggcttttggcgctgatatctactggcgtgggcgcgtatgggtggatcagttctggtttggtctgaaagggatggagcgttacggttatcgtgatgatgccctgaagctggcggatacgttcttccggcacgccaaagggttaaccgccgatggaccaattcaggaaaattacaacccgctgacaggcgcacagcaaggcgcaccaaatttctcctggagtgccgcgcatttgtatatgttgtataacgattttttccgtaagcaataatttgcaactgctggcggatgcggcgtaaacgccttatccgccctacatgtgcaatcctcctggccggataaaacgcggcaagcgttgcatccggcaactgcaccgcgccactggcggatgcggcgtgaacgccttatccgccctacatgtgcaatcccccaggccggataaaacacggcaagcgtcgcatccggcgttatcaccgggcgtattctttttgaatcccatcacaaaccccgcactccccttttcccttttctccggcgacggctaaattagaactcatccgaccacataacaattattttacatactggacaattttatgagctacccgtcgctgttcgccccgctggatttaggttttaccacgttaaaaaaccgcgtgttgatgggctcaatgcacaccgggctggaggaatacccggacggtgccgagcggctggcagcgttttatgccgaacgcgcccgtcacggcgtggcgctgattgtcagcggcggcattgcaccagatttaacaggcgttggcatggaaggtggcgcaatgctcaacgacgccagccagatcccacaccatcgcaccattaccgaagcggtacatcaggaaggcggcaaaatagccctgcaaattttgcataccgggcgctacagctaccaaccgcatctggtcgctccctccgcattgcaggcccccatcaaccgtttcgttcctcacgaactcacccatgaagagatcctgcaactgatcgacgatttcgcccactgcgcgcaactggcacgggaggcaggatacgacggtgtagaggtaatggggtccgaagggtatttgatcaacgaatttctgacgctgcgcaccaatcagcgtagtgaccagtggggcggcgattaccgcaaccggatgcgatttgccgtagaagtagtgcgtgcggtgcgcgaacgcgtcggcaacgacttcattattatctaccgactgtcgatgctcgacctggtcgaagacggcgggacttttgccgaaacggtagagctggcgcaggccattgaagcggcgggcgcgaccattatcaacaccggcattggctggcatgaagcacgtattccgaccattgccacgcccgtgccgcgcggcgcatttagctgggtcacgcgcaaactgaaaggccacgtctcgctgccgctggtaaccaccaaccggattaacgatccgcaggttgccgacgatattctctcgcgcggcgatgccgatatggtatcgatggcacgaccgtttcttgctgatgcggaactgctgtcaaaagcgcaatcggggcgagccgatgagatcaacacctgcattggctgcaatcaggcctgcctcgatcagatcttcgttggcaaagtcacctcgtgcctggtgaatcctcgcgcctgccacgaaaccaaaatgccaatccttcctgccgtgcagaaaaaaaatctggcggtggtcggtgcgggacctgctgggctggcgtttgccattaacgcggcggcgcgtgggcatcaggtaacattgtttgatgcccacagcgagatcggcgggcagtttaatatcgccaaacagatccccggcaaagaggagttttacgaaacgctgcgctattaccaccggatgatcgaagtgacgggcgtgacgctgaaactcaatcacaccgtgacggcggatcagttacaggcgttcgatgaaacgatcctcgccagtgggatcgtgccgcgcgttccgcctatcgacgggatcgatcatccgaaggtattaagttatctcgatgtactgcgcgacaaagcgccggtaggcaacaaggttgccatcatcggttgtggcgggattggttttgatacggcgatgtatttaagtcagccgggcgaatccaccagccagaatatcgccgggttctgtaatgagtgggggatcgacagcagcctacaacaggctggtggcttaagcccgcagggaatgcagatcccgcgtagcccacggcaaattgtgatgctccagcgcaaagccagcaaaccaggacaggggttaggcaaaaccaccggctggatccatcgcaccaccctgctctcgcggggtgtgaaaatgatcccaggcgtaagttatcagaagattgacgatgacgggctgcatgtggtgatcaacggcgaaacgcaggtattagcagtggacaatgtggtgatctgcgcagggcaagagccaaaccgcgcgctggcgcaaccgctgattgatagcgggaaaactgtgcatttaattggcggctgcgatgtggctatggagctggacgcacgacgggcaattgcccagggaacacggctggcgctggagatttaaatcgttatttgaagcgccggatgcaacgcatccggcacgtcgcgttaatcaataaacaaggcgggagaaatgccgaatcgcgttgccaattttttagcgtgttccagcgttaatttcctcttcccgctcaaaacgcgtgacaccatagatttactgccaatttccggcagatcggaaagggttaaaccatattgatccataagggtacgaatcacggctataccgccaggcatggcttgagccatggcattaaattccgcaaattcgggcgctgattcttcccacgcggttattttggcacacaccagatccagcaaggggttttcaggagcgttgagcagcagatgatctaccagttccagcgcctgggtgtattgttcctcgttctgaatacccgccagaaaaggtgccaccgcagttagcttttctcctgcttgcaagatgtcggcaatcgcaatcattttttccccttagtacgatgaacagcggtaaagaaatcgtattctttatgcgtcataacttcacgtatgtagcacttttgcgattcaaaaaagaccattgctacaacacgtaattcattgcccccaacattgaaaacataatgcttatccagatatttgaagttatccagagatgggaatactgcttttaatgactcaggttttttgaaatatcccttagcaatcgtgttccctagagccaccaactccgttttatgttgcgggtatttttccgcagcatctttcaatgctttttgagttatcaggtgcattcttcatcacgtccgttgacaaattggcaatatgataacatccgttgacagattggcaacggatgaatttatctgtgtgacggaagaataaacgtagaaaaacgctaaacaagagaatgtagaggatggtgagagggattttttgttttatggaagcgcgattccagaactgggcagacattgccggatgcgacgcttgccgcgtcttatccggcctgggagtaacgtgctgaacgtaggccggataaggcgttaacgccgcatccggcaggtaactcccaatcttaccgacgacgccccagcttcactgttttcagcaccacaaatttattattcgtggcgatggtggtgcagttgccgaaaatcttcttcagtttatggaagtaatccaggtgacggttggcaacgatatacagttcgccgttgattttcaggcagcggcgggcgtggtggaacatctcccaggcgacgttatcggtcagcgcatgttgctgatgaaacggcgggttgcagagcacagcattaaagcggaaaggctccactccggagagcgcgttgttgatcataaactcgcagcgatccaacgcctctggcatgttggtttcaacattcattcggctggaagcgaccgccatcggcgattcatcgacaaacaccactttcgcctgcgggtttttatcaagcagcgtcaggccaataacgccgttaccacagccgagatcgacaatctcaccttcgagattctctggcagatgttgcataaagaagcgtgcgccaatatccagcccggtgcgggagaagacattcgcatggttgtggatagtccagtcagtaccttccagcttccagctaacggtctgcggcgcatcggccagcggcggttcattgaaagtgcaattaatcaggcgcgcttttttccatgccagcgtagtggtggtcggtccgagcactttctcgaacagctccagcgtggaagtgtgaatgtcacgggctttggcaccggcaataatacgtgtatccgacgtgaccactttgcgcagcgcacgcagttgctgttccagcaatgccagtgttttcggcactttgatcagcaccacacccggctgttgcaggtagtcggcggtgctgtcgagaaacttcacgctcgactcatcaatcccgtttaggcgtaaattctcgcgcgtcgccagttcactgatgtatgagtcgccaatgctgtacggcttatgttccgccagcgcacaacttaacgcaccaaaggcatcattcaggatcaacaccgggccgcggatttctgtgtcgtccaactgttgcagcaaatattcatccgccgcttcccacgcctgtagcgggttaacgtcatccgtcgccggaaaacgttgcagtgtcagtgaacggaaaccgttgtctaagtggctcatcggccctcctgaatgataaaatttcgacgttgcccctgaaaagggtgcgtgagtataccctttttctctttttcgtgggtggttatgagcaatcttacttatcttcagggttatcccgagcagctactttcccaggtgcgaacgctgattaacgaacagcgtctgggcgatgtgctggcaaaacgctatccgggaacacacgactacgccaccgataaagccctctggcaatatactcaggatctaaaaaatcagtttctgcgcaatgccccgccgatcaataaagtgatgtatgacaataagatccatgtgctaaaaaacgcgctcgggttacataccgctgtttctcgtgtgcagggcggcaagctgaaagcaaaagcagagatccgcgtcgctactgtgtttcgcaacgcgccggaaccgtttttacgtatgatcgtggtgcacgaactggcgcacctgaaggagaaagagcataacaaagcgttttaccagttgtgctgccatatggagccgcagtaccaccagcttgagttcgacacccggctgtggctaacgcagttgtcgcttgggcaggacaaaatctgaaaatgatgtcaggcgttatcttttctttctttagcgcctaaaatcgacctcccccctttcgttaaggataacgaccatgcagccccgccttcttctccgtatttgtttttctcgccggactcttaagattggctgtttgttgttgcttatagcaggagcgaccatttttattgccgatcgcgttatggtcaacgccagcaaacagctgacctggagcgatgtcaacgcagttccggcgcgtaacgtgggcttattgctgggggccaggccgggtaatcgctactttacccgacgtattgataccgcagcagcgttgtaccacgccggaaaagtgaaatggctactggtaagtggcgataacggacgtaaaaattacgatgaagcctcaggtatgcagcaggctttgatcgctaaagacgtaccggcaaaagtgatcttctgcgactatgccggattctcaacgctggattcggtagtgcgtgccaaaaaggtttttggtgaaaaccatatcaccattatctcgcaagaatttcataatcaacgcgccatctggctggcaaaacagtacggcatcgacgctatcggttttaacgcgccagacctcaatatgaagcacggtttttatactcaactgcgggagaaactcgctcgtgtcagcgccgtgattgacgccaaaatcctccatcgccagccgaaatatctcgggccttcggtcatgattgggccgtttagtgagcatggctgtccggcgcagaaataatgcgtatctgcgcacgtcgaagatgaaaaaggcgtgctacattgacgacagaatccctttatggagtatccacgcgttatgatacgtttcgctgtgattggtacgaactggatcactcgccagttcgtcgaggccgcccatgagagcggtaaatacaagttaaccgccgtatattcccgcagccttgaacaggcccagcacttcgccaatgatttttctgtcgagcatctgtttacctcgctggaagcgatggcggaaagcgatgccattgacgcggtgtatattgccagcccgaattccctgcatttttcccagacacaacttttccttagccataaaattaatgtgatttgcgagaaaccgctggcgtcgaatctggcggaagtggatgccgccattgcctgtgcgcgggaaaatcaggtggtgctgtttgaggcatttaaaaccgcctgcctgccgaactttcatttgttgcgccaggcgctgccgaaagtcggcaaactgcggaaagtctttttcaactattgccagtattcctcgcggtatcaacgttacctggatggtgagaatcccaacacctttaatccggcattctctaacggttcaattatggatatcggtttttactgtctggcgtcggcggtggcgttatttggtgagccgaaaagcgtgcaggcaaccgccagtttgctggcaagcggcgttgacgcccagggcgtggtggtgatggattacggtgatttcagcgtcaccttgcagcactcaaaagtcagtgattctgtcctggcgagcgagattcagggcgaagcaggatcgctggtgattgaaaaactgtctgaatgccagaaagtgtgcttcgtgccgcgtggcagccaaatgcaggatctcacccagccgcagcatattaataccatgctctacgaagcagagctgttcgctaccctggtggatgagcatctggtggatcatccagggctggcggtcagtcgcatcaccgccaaactgctgaccgagatccgccgccagactggggtgatttttccggcagatagcgtaaaactataattgccaaagtaaaacagtgtaaaaggtatgtaacagaccattgactggctgaatggtctgtcatactttgttacctgcaaaggggagtaacttcattgccggtcgatcgtcattacgatgtgtgaaaaaccacatccggtcaccgggcaacccgaaaggaatacgcagacgtattccttttttgttgtaagtgagaccttgccggaaggcgaggtctatgcataaaaagcagcggctgacgtcttccgacgttggccgtttttttatgtgtaaggaacttctatgaatactgtcggcacgccgttgctatggggcggattcgctgttgttgtcgccattatgctggctatcgacctgttgttgcaggggcgtcgtggggcacatgccatgaccatgaaacaggctgcggcctggtcgctggtctgggtgacgctgtcgttactgtttaacgccgctttctggtggtatctggtgcaaaccgaaggtcgcgccgttgccgatccacaggcactggcctttctcacaggttatctgattgagaaatcgctggcggtcgataacgtctttgtctggctgatgttgttcagctatttctctgttccgacggcattacaacgccgcgtgctggtgtatggcgtgctcggggcgattgttctgcgtaccatcatgatcttcactggcagctggctaatttcgcagttcgactggatcctgtatatcttcggtgccttcctgctgtttaccggcgtgaagatggcgctcgcccatgaagatgaatcaggcattggcgacaagccgctggtgcgctggctacgcggtcatttgcgcatgaccgacaccatcgacaacgagcatttctttgtgcgtaagaatggattgctgtacgccacaccgctgatgctggtactgattctggtggaattgagcgacgtgattttcgccgtggatagcattccggctatcttcgccgtgaccactgacccgttcattgtgctgacctcaaacctgtttgcgatcctcggcctgcgtgcgatgtatttcctgctggcgggcgtagcagagcgtttctcgatgctcaaatatggcctggcggtgattctggtgtttatcggtatcaagatgctgattgtcgacttctaccatattccaatcgccgtctcgctgggcgtggtgtttggcattctggtgatgacgtttattatcaacgcctgggtgaattatcggcatgataagcagcggggagaatgattcgctgtatattaagccattcctagagataactcattccagacaaaggtgagctattaattatgtaatcggcttgtagctctttacaaaaagaccgcacgggtgttggtggcgtcaaaatcgccgaagcgttccctggaggccggggcgacgcgcatggatgcgcggcgagggcgcatcttacagggacgttcccttgcgcccgacccggtagccgcaagggataagctgagggaatcgcgcagcggcgattttgttcgccagagcctgggggtgcagggggcggcggcgattggccgccccctgcgcgctccctgcgccagtgactttatatggcatagcacattaaaggagcgcaaccgttctcatattccaaatagttttgcccatatgttatctaatcagccttagtagccagtccttccctctgtttatgtcaaacaaatgtaacaattaagttgcaaaacatgacctctctttaaaatccagcatttttcgcttcccgaagctgtaactttccttatactcgaccttgcaaacactttgttacatcctgaaagatgcgtcgacagaacgcaccagggatgtgcgacaacacaatgaaaggatcgaaaaatgactacgcaacgttcaccggggctattccggcgtctggctcatggcagcctggtaaaacaaatcctggtcggccttgttctggggattcttctggcatggatctcaaaacccgcggcggaagctgttggtctgttaggtactttgttcgtcggcgcactgaaagctgttgcccccatcctggtgttgatgctggtaatggcatctattgctaaccaccagcacggtcagaaaaccaatatccgccctattttgttcctctatctactgggcaccttctctgctgctctggccgcagtagtcttcagctttgccttcccttctaccctgcatttatccagtagcgcgggtgatatttcgccgccgtcaggcattgtcgaagtgatgcgcgggctggtaatgagcatggtttccaaccccatcgacgcgctgctgaaaggtaactacatcgggattctggtgtgggcgatcggcctcggcttcgcactgcgtcacggtaacgagaccaccaaaaacctggtcaacgatatgtcgaatgccgtcacctttatggtgaaactggtcattcgcttcgcaccgattggtatttttggtctggtttcttctaccctggcaaccaccggtttctccacactgtggggctacgcgcaactgctgttcgtgctggttggctgcatgttaatggtggcgctggtggttaacccattgctggtgtggtggaaaattcgtcgtaacccgttcccgctggtgctgctgtgcctgcgcgaaagcggtgtgtatgccttcttcacccgcagctctgcagcgaacattccggtgaatatggcgctgtgtgaaaagctgaatctggatcgcgatacctattccgtttctattccgctgggagccaccatcaatatggcgggcgcagcaatcactattaccgtgttgacgctggctgcggttaatacgctgggtattccggtcgatctgcccacggcgctgctgttgagcgtggtggcttctctgtgtgcctgtggcgcatccggcgtggcgggggggtctctgctgctgatcccactggcctgtaatatgttcggtatttcgaacgatatcgccatgcaggtggttgccgtcggctttatcatcggcgtattgcaggactcttgcgaaaccgcgctgaactcttcaactgacgtgctgttcactgcggcagcttgccaggcagaagacgatcgtctggcaaatagcgccctgcgtaattaattgtttaacccctttcgtctacggcggaaggggttttctcaactttaaacggatcaattccccttttctgcatccgccagaaacgaatgatattcaggccattcataagcagaaaactaccctcaatcatcgtgccgcctatcgaccccgcccagaagttgtgaatcacccagcaacacgttgaaaaccacattacgcagcgcatggtcagccctttacagcggaatagcgcccaggtactgacaatcgtgccgataaccggcaatagttcgacaggatgatggaacttcgcgaggccaattccgccagtcagcacaataaaaatcgccattacccataagctgcgcgtgcgtaaggtaatcaatgtacgaatggcattaaggatggcactggcaccagcgggataggtgcccagaagaaaaaaatgtacgccaataacggcgctatagaccgaaagctgctttttgaagcgacgttcgtcacgattgaaaaatgttgtgataccaatcagaaaggcgatgacacccacgccctgggccagccaatacgcggtcatgataaatccttagcaggtatggaaaagcaaacggcgcttcacattatgaaacgccgttttttattaacaactcatttcgactttatagcgttacgccgcttttgaagatcgccagttcgcggaagtcgttacgctcgttacaggtttgcttaccgttggcaaactcaacgatggtgtcgataaattcttccagcaactgcggcatcgctttaccgtggatcaactgacccgcgtcaaagtcgatccagtgttttttcttcgccgccagttcactgttggtggcgattttcaccgtcggcacaaatccaccatacggcgtgccacgaccagtactgaacagcaccatatggcagcccgcacccgccagggcgctggtcgctacggcatcgttacccggcgcacttaacaagttcagccctggcgttttcagacgctcgccgtaacgcagcacgtcaaccacgacgctggaacccgctttctgggtacagccaagtgatttgtcttccagcgtggtgataccgcccgctttgttccccggcgatgggttttcatagatcggctgatcatgggcaataaagtactgtttgaagtcgttgaccatggtgaccagtttttcaaacgttgcttcgtcgcggcaatggtccatcagcaactgctctgcgccaaacatctccggcacttcggtcagtacggtagtaccgccgttagcaatcacgtagtcagagaaacgccccagcatcgggttagcagtaataccagaaagaccgtcagaaccaccgcactccagaccaaacttcagttcgctgagtttgcctggctcgcgtttatcgttgcgcatcacgttatacagctgatgcaaatgctcgattccggcttcgatctcatcatcctgctgttggcagatcatgaaatgaacgcgttcaggatcgatatcgcccagcgtttcacggaatgcggcaacctggttgttttcacagcccagaccaatcaccagcactgcgcctgcgttcgggtggcgcaccatgttttgcagcatggtgcgggtattaatgtgatcgtcgcccagctgtgagcagccgtaggtgtggctgaagaggaacacgccgtcggtaccttcggcgttgttggtttctttcaggaaacgattttggatctgccgcgcgatgccgttgacacagcccacggttggcaggatccacagctcattacgcaccccgacatcgccgttagcgcgacgatagatctgcacttcacgatctgccgcttgcgcaggcagatcctgaaaatcaggttgatagcgatactgatccagatcgctcagattcgtgcgcgtattgtgggcgtgaacgtgttcccccgccgcaatatccgccaatgcataaccaatcggcaggccatatttgatgacgttggccccttttgcgatattcgttaacgcaaatttatgtccacgagcaacatcctggcgcagcctaacagtttggttatcgacactgacttctgtgccttcagccaaatccgctaaagcgaccgcgacgttatccagcgcatggatcttgatgtattgcatatcaaccccagaccttagttcagttcaatggcgaagtagtcacgcgcattgttaaagcaaatatttttcaccatctcgcccagcaggttgatgtccgccggtgcttcgcccgcttccacccagcgaccgatcatctggcacagaatgcggcggaagtattcgtgacgggtgtatgacaggaagctacggctgtcagttagcataccgacaaagcggctcagcaaaccgagctgcgccagttgggtcatctgacgttccataccgtctttctgatcgttaaaccaccagccggaaccgaactgcattttgcccggcataccttcgccctggaagttaccgatcatggtgcccagcacttcgttatcgcgcgggttcaggcagtagagaatggttttcggcagcaggttttcttcattctgcttgctcagcaacttagacagctcttccgccatcggacggtcgttgatggagtcaaagcctacatccggccccagcagtttgaactgacgcaggttgttattacgcagcgcgccaatgtggtactgctgtacccagccgcgacgtgcatattcggcaccaaggaacaccagtaccgcagttttgaactgcgccacttcgtgctcgctcagggtttcgccagccagacggcgcgccagaatgctgtccagttccgcttcgttcgcttcagcaaacatcaccacatccagcgcgtggtcagacactttacagccgtgagcggcgaagtgatccagacgtttggtcagggcagtttgcaggtcagcaaagcggcgaatgtcggtatcggaaacttcgcccagcttcgccatgtagtcgttaaaggtcgcctgttcgatgttgaaggctttgtccggacgccagctcggcagcactttgatggtgaaagagccgtctttggcgatctctgcgtgatgctccagagaatcgatcgggtcatcggtggtgccgaccattttcacgttcatctgctgcatgatgccgcgcgcggagaagttatcctgcgccagcagttcgttacattcgttccagatttcatcggcagttgacggagaaagcaatttgccagtgataccaaacggacggcgcagttcgaggtgcgtccagtggtataacgggttgccgatagtgtgcggaacagtcgccgcccaggcgtcaaatttttcacggtcagacgcatcaccggtacacagacgctcggccacaccgttggtacgcatagcgcgccatttgtagtgatcgcctttcagccagatgtcatacaggtttttaaaacgatagtcttccgcaatctgctgcggcggcaaatggcaatggtaatcgaaaatcggctggtcttttgcgtagtcgtgatacagacggcgggcaaattcggtatctaacaggaaatcttcagtcataaacggagtcattttcgtcttcctctcaacgagtgagctagcttgcttatggtgcgatgctgacaaagttatcacaccaatttccagagtccgaagatattttcgtgagttagatcaataaacgtagttaaaaaaattactctcaaagtggtaaatctcgctgcaggccgcgccagtactggcctcgctgtcgtcaggtaatgtccctacaaatattcgcacatttgtgatggctctcaccttttaaagttgtatgacaagttatctttctgccgtcgcaaatcataagtcgacggaatgcaaattgccgattcattcatttgttagatgaatcgggttaaccggtacggaagccgaattagcacgaaactttcatggcaacgttcggggcgtgccggttttttttcggttacccggtcgtaactaacatcttcagcctctggcgggatgatggccgcgcttcctgcggatataacaaaacgatgaggttttacatgcgtaaaattaaagggttacgttggtatatgatcgcactggtgacgctcggcaccgtgcttggttacctgacgcgtaacactgtggcggcagctgcgccaactctgatggaagagttaaacatctccacccaacagtattcctatatcatcgcagcctattctgctgcttatacggtcatgcaaccggtagcaggttatgtactggatgtgctgggtacgaaaatcggttatgcaatgtttgctgtgctgtgggccgtgttctgtggtgcaaccgcgctggcaggtagctggggtggcttggctgttgctcgtggtgcggtcggtgccgcggaagcagcgatgatcccggcgggtctgaaagccagctccgaatggttcccggcgaaagagcgttccatcgcagtaggctactttaacgtaggttcttcgattggtgcgatgattgcgccgccgctggtggtatgggcaatcgtaatgcacagctggcagatggcatttatcatctccggtgcattgagctttatctgggcgatggcatggctgattttctataaacatccgcgcgaccagaagcatctgaccgatgaagaacgcgactatattattaatggtcaggaagcccagcaccaggtgagcacggcgaagaaaatgtccgttggtcagatcctgcgtaaccgtcagttctggggtatcgcgctgccgcgtttcctggcagaaccggcctggggtacttttaacgcgtggatcccgctgttcatgtttaaagtttacggctttaacctgaaagagatcgcgatgttcgcctggatgccgatgctgtttgctgacctcggttgtatcctcggtggttacctgccgccgctgttccagcgttggtttggtgtgaacctgatcgtttcccgtaagatggtcgtaacgctgggtgcagtgctgatgattggcccgggtatgatcggcctgttcaccaacccgtatgtcgcaattatgctgctgtgtatcggtggttttgcccaccaggcactgtctggcgcgctgattacgctctcttccgatgtgtttggtcgtaacgaagtggcaacggcgaacggtttaaccgggatgtccgcatggctggcaagtacgctatttgcgctggttgtcggtgcactggctgacaccatcggcttcagcccgctgttcgcagtactggcagtgttcgacctgttaggtgcgctggttatctggaccgtgttgcagaacaaaccggcgattgaggtggcgcaggaaacacataacgatcccgcaccgcaacattaacatttaacgtaagttgtaatgacgaagccgccttatcaggcggcttcgttgtttatatagacaaaagcgtttgtccggtttgcagggttaattgatggttggcaaggaaggcgtaaagattaccgacaatttccccatgtaatatccagcctgtttgtccatcacgctaaatttttctactgccagcgttaatggcgttggcacacacattacggcatagcggatccctggcaatacgaccggacgcacacgtttcaggttaatgctgttccagaccatattttcattattgcgcacatcaatttgcccaccggtttccgggttgtacattttgacccggtaatcaatgcgttctccctcgtcggtggtggttcctccctgacgatagatagagaagtcaccgtctctgcgccctgcggcgggtcgcccttcatctttgagcatgatttcataactgatggcattaccgttaaaaccatcgtacaagcacatgtccaacatggtcagatcttgcgcgtagttgctgccattaacgctccctgttggatgcaagtctaactgcacccgtggcgtggcgtgggcgaactccgggaagaacacgtcgatatggttggggtcgagaacattaagcttaatatcagcctgataatctgttgccgggtagctaaaatggagtttaactttcccttcccataaaccgccaatcggcagtttcttcatttcttcttgctcaatatacagagttaaaacttttgttttagccagataaccaacgttattaatcgtatctttacattgataacccgtcccatcatccagccttttcttatcgtaccaccccttacacggtccgtcctcccacacctgaactgtcatataccctttcagtttaaccggccagcgcataccgctgcgtttttcagttagataaatttgcacgacagaagtattacctgctgatgtacaagtctgctgtgaatcagggtagctacattgaaaaaatgaaaatgttgtactgtaactcacctccggtgggggctcctcattccagaagtaataatccgctctgccagatgccaaatcgtacgtaatttcactggtcacgttaggagctgcctgaacgccagtaaccgcaccacacaagcccaatatcgccgcaatcaatcgatttctcatggtgcaacctccctttgcgccgtctgaacgtttccacgtaatttaggctgtttcaactgtgcctgaacctgaatggactccggtaattgtgaataagtcaccacactacatgtgacatctccgctgtaacgaatgctggcgcgtttctttacaacactcagcggacacttaaggaattgctgcccggaaagcagatatagctctttttcgctaccgttaatttcaagtgtaaatccgccatcttcagctaccagtaacatggcgctattcagaccaaccagcgggaatttctctaccgatgctggtaataacaagcgaccgatatagttgtaattaaagctggcagacacttcgcgatagcgcagtttgccaggcaacaacattaattcacgattccccgcaccgttaatgatgtttgttgtcccttgttgattgccctggctactgtcgttaacctcaacaaaaccagactgaaatccaggataagggaacaacacactgtcgctttgaccaagctgcaacgttcggctgcctgccacccgcgcttcgagttgcagatcctgactctcttcatcctgttcagagaagcctttcacatccaccaataccgcacccagcaaatcgtctgtaccactggcacccaaattaacgccatagcgactgacagccagtgtagagctgtaagtccccgtaaaggccgagagatgatcatgattcttacggtcataactgtcagatacggtagcgtagacatttccgtattgaccatcccaacgcccgttaaccgcgctgtttatggtatcggtgttcaggcccccaacggttacgccaagttctttatggctgaatgaatcgttataaaaagtatgggataactgccatgacgtttgatcgccatcctgatcgctataacgataatccgtagaaacattggttgaatggctgttgttattgctgtccatcgttggcgtgtcagataacgaaaacgataagtacaagccgttgtcgtcgttatcgccaccgttgtcattacgatggaaaacaccaaccgaagtactcaagatccagtcacgcatcacaaaagcgcgggaagcgctaagttgtacagtttcggagatactttgcgcagttgtctggcgaagatagttattttcaaagctctgctgtttatcccaacgcaaactatcatcagtgttattttgtgtgcgggaataacccagcatcatattccagccgacaaaattctgtgaaaccgtcgcggaaatactttcataacagcttaaggcgttatagctctctctgctgtcggttgcacaagcatcgccgtcagagttggtccgataaaagcccaacgtcggccatcccgaattactccagttggcctgttgcatatcacctttgccgccgtcatcgttacggaacacgctggcgctgattgcaagattccctgccccgcctaaatttgccgtccagtcattacctaactcgaaagcactcacattatcggcattcgccagccctgcgtagagctcatattgcggatgtaatggcaggcgtacccccagttgataagctgaactttcatcatcagaagcctgtgatgtagttttacctgcctgtaagaaccattgcgcatttccgtccgtcagaccgcctgttttggtaaacggtactagctcggtgcgggtgagttggttattttcatagacttttaacgctacgctatagctacccgggggaaaggaactggtatcaataaattgcgaaccactattgagataaaacgatcccagaagttgctcattacgataagcgtcaacacgagaattgcgcgaaagcaggaccattaccggggttccctgctggctttgcgcctggtttaaatagctaagagtcgacccgatacgcatcccgtcgattgcaccgagtggcaaaaagttaaaggtaaagttcccgccttgtgcattaaatagcgtgcggttgtccatgcgccccgcctgcacataataacgacgtaaaaaatcataacgataatagagatcgctgacatcagcattactgtcactgacatcatctgcatcataaccgttgaaattccagtgtgcaccaatatagctattttctgttattcccagcgcaccgtttccctgaatagacaacgattggtaatcatcctgtgccagaacattgatgtcttgctgatgtataaaagcgttaaccgtatttttgtctggatttaaatataatgacttcgcatcgaaagctgaattccattgcggattaataaacaacgttgccgaactttcttcatcattatagattatttccagcgtatcggtattcagaaaaccacaccctgagtcagtacgtacataaccgcaagccaattcaccgtggcgagctagcggctgcgataatttttctttcactatatgcgcgattttctgatcgtcgacatccagttccagcttgttatataaacttgctggatcaagaaatgttacggtatcaagattaaccattgcataatatttaccgagatttttccctgaaaaataaacctcgatatactcctgctgtccctgagcaataacctcaaaccctgcggggattttggttaatgccgcctctgccgggctgagactcgccaggatcaaaagagccagtaattttttatccatggcaatcctgaaatccataacaaatactaaaacagttaaaataaaggagggctagcccccctttgttatgtgttaattctgttatccggattagatatcctgagacagataaatgcttactacgccacggtagatacctgtttccagaacacctttggtggtttgagcaaacatcagatttttagccagagaaccattagttaacgcatcggaagcaaagattttggttgcggtaaaagtggttgccgcatcagctttaatttcttcgccgccccaggttactgtcagcggaacaatcttgctagcgtccaggctttgaaccagttgcgccggggaaactaactgcatttttacatctttggtaacgtcgttagaccagattttggtcattaactggtaagattgcagaccctgacccggcagatattgcatttctactgctttcggcagcgcagtgttatcggtctgtgtcatatccagagcggcatcaacgttagccgttacagtgatatccttttgtactgctaatgcggagcctgcaacagaaaacatcgctgcgaccagaagagattttgcaaatacctttttcattactattccttcgtttattacaatgataattaatggaccgccagttcaaactcgccattatctttggtgatccagttattatatttgacaacgattttgtcgtagccagatatgctttcaagatttctttcctgaccagggaagatatttttatttacagtctgtatcttacaattttctttgctattatttttacaataagcgatcgttaaaatctttaagcgttgattccctgcattaactaatttttgggcagcatttacttctaacttagcaataggttgctgaggtgggacactaacaacaatcccccaaattaagttaactgttaactgcatagagagatcttttttatccgtggcaacgtcatcaatactgggaaccgcttcaaatttaacgcgataatttttttctttttgctctggttccattgcaacaaagcgcacagtcttactgctacccgctggcagcgcaaacttaggcggcatcactacaagatgagtggcatctccggattttatttcaacttcctgctcttgaggcgttgaaggattatcaatacgaaataccgtcgcttttatatattgaacttcattacttttagatattacgcgaacgttaccttccccctgactattaatggaaacagccataggataaacagtcatatttgactgtgcaaaaaaaggagcgaacacgaataaaagcggcgtaagccgtgataagagattaattttcgccaccatatagatttgatcttacaatattgattcaaaaaagttagtgcattagatgtgtatatttattgtaagtcaacatgaaaaagtatttttagttaatattaaatttaaaagcgaaaaattaacttactgaaatatagcaattttcacaatagagacacttcatttttaggaatttataaatattcacaatcttgattaaatacattatttcaatcatcaaatttatatatcaacaatggcatacccataaataaagtggtatgataactttgtccgcattccactccgggagacgcatatggaaatcactgaaccacgccgtttgtatcaacaacttgccgctgacctgaaagagcgcatcgaacagggcgtctatctggtgggtgataaactgcctgccgagcgctttattgccgatgaaaagaacgtcagccgtacggtagttcgtgaagccatcatcatgctggaagttgaaggctatgtcgaagtgcgtaaaggttcaggtattcacgtggtttccaaccagccgcgccatcagcaggctgcggacaataatatggaattcgccaattacggtccgtttgagttgctccaggctcgccaactcatcgaaagtaatattgccgagttcgcagcaactcaggtaacgaaacaggacatcatgaaattgatggccatccaggagcaggcgcgcggcgaacaatgcttccgtgattccgagtgggatttgcagttccatattcaggtagccctggcgacgcagaactccgccctggcggctatcgttgaaaaaatgtggacccagcgtagccataacccgtactggaaaaaactgcacgaacacattgattcccgtaccgtcgataactggtgtgatgaccacgatcaaatcctcaaggcgctgattcgcaaagatcctcatgctgctaagctggcaatgtggcagcacctggaaaacaccaagatcatgttatttaacgaaaccagcgacgacttcgagttcaatgccgaccgttatctgttcgccgaaaacccggtagtgcatctcgatacggccaccagtggcagtaaatgaaatacctgtccgacaggcgctgcgacgcgcctgtttgtctcgtcggtaagcgaaaagtataaagtgtcagcctgtgtaaatcctctcgccaccctcccctgcattcagcaaaatcagactccacggacatgtaattttgataacgaacaacgttgacctttgttacaattagattcaatttgaatttatgtttttgaatgctttcttatctcacgatttaacagggaatagttcaggctgtgttgatgtatcaaacccgcagaacataccaaaacagcaataacattgcggtagtgcatcttttaaaaccagcgtggcgttaaccgattcaccaggaataatgaatggaacttttgacccaattgctgcaagccctgtgggcgcaggattttgaaaccctggccaatccgtcgatgattggcatgttgtattttgtcttgtttgtaattttgttccttgaaaacggcttgcttccggcggcctttttaccgggcgacagtttactggtattggtcggcgtgttgattgcgaaaggcgcgatgggctatccgcaaacgattctgctgctgaccgttgccgccagcctcggctgctgggtcagctatattcaggggcgatggctgggcaatacccgcaccgtacaaaactggctatctcatttacccgcgcattatcatcaacgcgcacaccatctttttcataaacacggtttatcggcgctgttaattggtcgctttattgcgtttgtcagaacactgctgccgacgattgccgggttatcagggctgaataacgcgcgctttcagtttttcaactggatgagcggtctgctgtgggtattgatcctgacaactctgggttacatgctcggcaaaacgccggtatttttaaagtacgaggaccagctgatgtcatgcctgatgctgctcccggtggtgctgctggtgtttggcctggcaggttctctggtcgtgttatggaaaaagaaatatggaaatcgggggtaagggatgcaaatacctcgcatgtcgcttcgccagctagcctggtccggcgctgttttacttctggtcggcacgctgttgctggcctggtccgcggttcgccagcaagagtctacgctggcgattcgtgccgttcatcaaggcacaacgatgccagacggtttttcaatctggcatcaccttgacgctcatggcattcctttcaaaagtatcacccccaaaaacgacactctgttaattacctttgactccagcgaccagagcgccgctgcaaaagcggtcctcgacagaacattgccccaaggctacatcattgcgcagcaggacaataacagtcaggctatgcagtggctgacccggctacgggataactctcatcgcttcggataacttcctgttatccgaaacagatcactcactttggtgatttcaccgtaactgtctatgattaatgaggcggtggttaacactaccgcttcgttgtctggacaatcgttcctttgtaataggtccgaatcacaatggaaggttcaagaatgaaataccgcatcgctttagctgtttctctttttgctcttagtgctggtagttatgccactaccctgtgtcaggaaaaggagcaaaatatccttaaggagatcagctatgccgaaaaacaccaaaaccagaatcgtattgacggtctgaataaagccctgagtgaagtccgggccaactgttcagatagccagctgcgtgccgatcatcagaagaaaatcgcaaagcagaaagatgaggtggcggaacgccagcaagatttagccgaggcgaagcaaaaaggcgatgccgataagattgccaaacgcgaacggaaactggcagaagcgcaggaagagctgaaaaagctggaagcgcgcgactactaactcacaatagtcactacttactcacctggagaaaactatgtcgaaagaacacactacggaacatctgcgtgctgagttgaaatccctttccgatacgctggaagaggtgcttagctcatctggcgagaagtcgaaagaagagttgagtaagattcgtagcaaagcggagcaggcactgaaacagagccgttatcgcctgggtgaaaccggtgatgccatcgccaaacaaacccgtgtcgcggcggcgcgtgccgatgagtatgtgcgtgaaaatccatggacgggcgtgggcattggcgctgcaatcggtgtagtgctcggcgttctgctgtcgcgtcgttaattatggcggacactcatcacgcgcaagggcccggtaaaagcgttctgggcatcgggcagcgaattgtttccatcatggttgaaatggtggaaacacgtctgcggctggcggtggttgagctggaagaggaaaaagctaatctctttcaacttttactgatgctgggcctgacgatgcttttcgctgcatttggtcttatgagcctgatggtgctaattatttgggcggttgatccgcaatatcgcctgaatgcgatgattgccaccaccgtggtgttgctgctactggcactgattggcggtatctggacgttacgtaaatcgcgtaaatccaccttgctgcgccatacacgccatgagctggcaaacgatcggcagctgctcgaggaggagtcccgtgagcagtaaagtcgaacgtgaacgacgtaaggcgcaactgcttagccagatccagcaacaacggctggatctttctgccagtcgtcgtgaatggctggaggcaacaggcgcttacgatcgtcgctggaatatgctgctaagtctgcgctcctgggcgctggttggcagtagcgtgatggcgatctggacgattcgccatcctaatatgctggtccgctgggccagacgcggttttggcgtatggagcgcctggcgtctggttaaaacgaccctcaagcagcaacagcttcgcggttaacttccctctggccggagccattccggccgtacccatcaaattttttgaagatttttgacagttttccttgctaacaatcatcattcaccacgtttatgattctctccatcgacagcaacgacgctaataccgcgcccttgcacaaaaaaacaatcagcagcctgagtggcgcagtggagagtatgatgaaaaaattagaagatgttggtgtactggtagcacgcattttaatgccgattctgtttattaccgctggctggggaaaaattactggctacgcgggtacccaacaatatatggaagcaatgggcgtcccgggttttatgctgccgctggtgattctgcttgagttcggtggtggtctggcaatcctgttcggtttcctgactcgcaccactgccctgtttactgcgggctttacgctgctgacggcatttttatttcacagcaactttgctgaaggcgtcaactcgctgatgttcatgaaaaacctgacaatttctggcggattcctgctgctggcaattaccggtccgggcgcgtatagcatcgaccgcctgctgaataaaaagtggtaagcacgcgctatacttaacgataaaaaacgaggaggaagctcctcgtttttgctattggaggagagaaaaatgggtcaactgattgacggcgtctggcatgacacctggtacgataccaaatctaccggcggtaaatttcaacgttcagcttccgcatttcgtaactggctcactgccgatggcgctcctggccccactggcacaggcggttttatcgcagagaaagatcgttatcatctctatgtttcactcgcctgcccgtgggcgcaccgcacgctgatcatgcgcaaactcaaaggactggaaccgtttatttccgtttccgtagtgaacccgctgatgctggaaaacggctggacctttgatgacagttttccgggagcaaccggagacacgctctatcaacatgaatttttgtatcagctttatctccgcgccgatccccactacagcggacgagttactgttcccgtgctgtgggacaaaaagaaccacaccatcgtcagcaacgaatcagcagaaatcatccgcatgtttaataccgcgtttgatgcgctgggcgcgaaagcgggtgattactacccaccagccctgcaaacgaaaattgacgaacttaacggctggatttatgacaccgttaacaacggcgtgtataaagctggttttgccaccagccagcaagcctacgacgaagcggtggagaaagtgtttgaatcgctggcgcgactggaacagattttaggtcagcatcgttacctgaccggcaaccagctaaccgaagccgatattcgcctgtggaccacgctggtccgttttgatccagtgtatgtgacccacttcaagtgtgataagcaccgcatcagcgattaccttaatctgtatggcttcctgcgcgatatctaccagatgccgggaattgccgaaacagtcaatttcgatcacatccgtaatcattacttccgcagccataagaccatcaaccctacggggattatttcaattggtccgtggcaggatctcgatgaaccgcatggacgagatgttcgcttcggttaaaaaaagcaccttacgaggtgcctctgataattagctaagtgcatgttgttcatgtcggatgcggcgtgaacgccttatcaaacctacaaaacatttatattcaatatgttgcaatgaccgcgcaggccagataagcgtagcgcatctggcgattttgcgcttgtcatcagtcttagcacgccttcatagccctttattaattccttgaacgaatatttactgccatttcattcacgtctattcttaatttgctgctttaaaaacaagtgattgagcaaaattgaggcaaaaatggactggtatctgaaagtactaaaaaattatgtcggtttccggggtcgtgcgcggcgcaaagagtactggatgtttattctggtcaacatcatctttacgttcgtgctggggctgctggataaaatgttaggctggcaacgcgctggtggcgaaggcatcctgacgacaatctacggtattctggtgtttttaccgtggtgggcagttcagttccgccgcctgcacgacaccgaccgctcggcgtggtgggcactgctattcttaatcccgtttatcggctggcttattatcatcgtctttaactgccaggcgggtacgccaggcgagaaccgctttggaccagatccaaaactggaaccttaaaacaaatctgctcgccggatgtctgactcatccggcttttatcatcatgttaatgaatgaataatttactaatgtttatttaaaatatttcaatgtcgttatataaattacctataaaaaataaccatgtatttatcttaaatatcaaaacctttataacatccgaaaaagaaagatacgaatagcatttacacaatacccggaatagactttcatcacttttaattaaagggatgtttttatgcagtggtatttgtccgtattaaaaaattatgttggtttctctggtcgcgcacgtcgtaaagagtactggatgtttactctgattaacgccatcgtcggcgctattatcaatgtcattcaattgattttaggtctggagcttccatatctgtctatgctttatttgctggcaaccttccttcccgtccttgcgcttgctatccgtcgcttacacgataccgaccgttcaggtgcctgggccttgctcttttttgttccgtttattggctggctcgtgcttctggtttttttctgcacagaaggtacttctggcagcaatcgttacggaaacgatccgaagtttggttcaaattaatcttagaattggggcgatatttcgcccctttttattaacaataataaatattattttccgttaaaaagtttgggaatttcccgcagacaccaggatttcgcttcccccatactgtcacgacgccaggccataataatatcgatctcgctggtcgattccgggctgacgacacgcaaccgcccttccgcaatatctttttcgaccataggatacggcatcgtcgccacgccaagccccgccagtaatgcctgacgtttatcttcaatcgtgctcaccgttaagcgcggctgtttgtccagcagctgtacggtcaacaccgggcgctcacgagcggtatccgccaccgcaattccacgatatttcacacgcgtcacttcagataacggttccggctcctgatgaatcgggtgatcaggcgcggcaacgtagacgttcattaacgtatagagcttgcgcgagttgatctccgacgaggaacgaaaatgcatatccggcgcgataacaatatccgcccgcccctgctccagccgttcccacgcccccgccagcacttctgtgatgattgccagttgggtattggcttttgccgccagtttgtcgattaacgggaaaaaggcaggtgtcggtaccagcgcttcggtcacaatggtgagatgcgtttcccaaccgcgcgcgagagcttccgcatcagtagtcagtttatctgcggcttccagcaaaacgcgccctcgctccagcaacatcctcccgacattggtgaatttggtacgatggcccgagcggtcaaacagcaccacatccagctcttcttccagtttttgcatggtgtagctaagtgcggaaggcacgcgtcccagctcatccgccgccgccgcaaaactgccccggcgatcgatcgcatccataacccgtagtgcttccagcgttaatgccctttctttggccatttcgttctcattcaggaaatttgaacataccgggcagaatatctggctaacaatgtagcgtccagccccttaccataaaaggaagtaaagagaggtcaagaattatgattactacccgaactgccaggcagtgtggacaagcagactacggatggttgcaggcccggtatactttttcctttggacactacttcgacccgaaattgttaggctatgcctccctgcgtgtgcttaaccaggaagtgctggccccaggtgccgcctttcagccgcgaacctatcccaaagtcgatattttaaatgtgattctggatggagaagcagagtatcgcgatagcgaaggcaatcatgttcaggccagcgccggagaggcgttgctgctctctacccagccgggtgtcagctatagcgaacacaatctcagcaaagacaaaccgttaacgcgaatgcagctttggctggacgcctgcccgcagcgagagaatccgctgattcaaaagctggcgcttaatatgggcaagcagcaattaatcgcctcgccagagggtgcgatgggaagcctgcaattacgccagcaagtgtggctgcaccatatcgtgctcgacaaaggcgaaagtgcgaatttccagttgcatgggccacgcgcgtatttgcaatcgattcacgggaaatttcatgcgcttacgcatcatgaagagaaagcggcgctgacctgcggtgatggggcgtttattcgtgacgaggctaacattacgctggttgccgattccccactgcgcgctttgctgatagatttgcctgtctagttgtttttacagggagatgatgatgagtaaaaaattggccaaaaagcgccagccggtgaagcccgtggtggcgaaagaacctgctcgcaccgccaaaaattttggctatgaagagatgttgagcgagctggaagctatcgtcgcggatgctgaaacgcgtttagtcgaggatgaagctaccgcgtaaagacaagttgccggatgcggcgaaaacgccttatccggcacaatacccaaaacctggcgtttatctggccttgctcgccataatctcgataatctgccgatcggtttgctgcatcgaatggcttgctaacgcacacaggttggcaatcgactgctcaacatcatgcgccacgatcccttcattgccggtcacggcggtatcatccagcgccattaacaccgctttccacgcagccgaagcactggtcgaaaccttcatcgcacagctgttcgacgctccatcgcaaatcatgccgctgacatcgccgatcatactgctgatcgccatcgagatagtttcataacgcccatccaccagccatgccatcccggcggcggcccccattgctgcggtcgttgcggcacaaagtgcagacaaacgcggtaactggttatggatgtaaattgcgctcaaatgcgaaagcatcagcgcacgcgccagccgttcatcatccgctccgaagtgttctgctaccaccaccacaggcattgttgcggtgatcccctggttacccgagccagagttactcattgccggaagcgtagcgccgcccatacgcgcatcggatgccgcgctggtacgaatcacaatggatgaagagagatctttcgccagcaaaccgcgcgcgcactgtttttccagcgtcgcgccaatatgcagcccccacttaccgctcaaaccttcctgcgataacgcacaatttagcttcgcagaatcgagaataaagcggatcgccgcaaacgggacttcattgacgaacttcaggatctcagccagcgtcgttctggaaagcaccgtcagcggagactcttgctcgccctctgccacacacgcctgctgggtaaacaccacaccatcgtgcgtctcaatatgcacaatgttggtatgcccgccgacgatggtgacacacgcccacttctcaccgttccagactttggcgcgtgagaagaggatttcattgcaaggttcctggatcttaacggagactttccccgccgccagcagtgctttggcatcggcaattgcctgcgcagttgcgtctttcagcacttccagcccggcgttggcatttccacctaacgcccccagcgccgccgcaatcggcagccccaccattcccgtgccgggaacggtgacgcccagaccgttcttcatcagatttggcgaaacccaggcttctacacgttcaaccggaccttccagttctgccgcagcaaccgccgccgccagcgccagtgaaatcggttcagtacatcccaacgccggttttacttcctcctgaacggcgaggatgtaacgctgccataacggatttaaagtcgaatcaaacatattaaaaaccttaaaatttcaggtaaatcaagaaaatgccaggaacggagaaacacaaagcaacaaaccagtgacgataatcaggtacagagacatccctttgtatttgtgcaatgccggtactttgtaaaccagccacgccgggatcaggcaccctaccatgccgaaaatcgggctacagatagaggtgaagctcaacaccggtgcgttcagtacgatggcgctccaggccagcaaaatggcgaaaatcatgatgccgcgctgaacaagattttcgttaatcttctcggcaggcatcttgcgacgcaggatgttcattacgatcccttgcgttgcttcgcgaaagcctaaatagacgccaaagaatgcagtcatgacagcaaagttattgagaatgacgctgaccactttcacccacgctgcgccgtcaccgctaataaactgtgcggcaatcgccagcgcggaaatattctgctcgtaggcttttaccgcttcgtcatgtcccatcgccagcgtgaacgacacggcgtagaaaaagacggtgacaaacaaaatgccaaacgcgatattcattgcccgcaatgctttatgccgcgccacttcaattgatttttcccgcgagcgataagagatcaccatcgggcttaacgtctggataaacagaatcgacgtcagggtaaacggcagcgtaataatggcgtttttcaccagcagccccagcggcggtagcgaaccgacgttatacagatgccacattcccaccatcgacacgcccagcgccgcgaccactagcagcttggtcagcaccatgccggtcgaaattttgaataacaatttctcgccgcgtgaagagatcgccaccagaatgcaaatcagtaccagaccataaaagggactgtctgacagcaacccttccgtcacgccgaaggtatgcagataggaagcactatcgttggtgatggcggtggaatagacgaacatccaaatcaccagcattacgaaatagagcgcacctaacaggatgccccagtttttacctaaataaccgctaatgacactcgggtaatctttacattctggtgattctgccagcgtattaataaacaaccgctgaaacagatacattgccgggtaaccaatcaccgatgagagcaaaaatacccacaatcccatcaaaccgacctgcaccgggagaaaaacaatccccgcgccaatcgccatcccgatactcataatcacccagccggtgtcagtactgtcgaatttgatcgcttctcgccactcgctctcactcattccagcacgacccgccggggtcgaagcgtctgcaatgacgcctttattcgatgcaatttccataatttctcgctcaaaattttgtagggcttattatttttttccgagccgcatcaaggcgatatgcggtctacgtttttgcaggcgagttattagaataaagaaatgatacgcgcgaggtcagagaaaatcttcacaatcaagactttgaaataacggagatggataagaattttctactaaattaatcgcaagagaatattcattctctatttgcggcagatcacaaaaaaaaggtgcacatttgtgcacccaaggatgaaagctgacagcaatgtcagccgcagaccactttaatggccagtcctccgcgtgatgtttcgcggtatttatcgttcatatctttgccggtttcatacatcgtctcgatcactttatcgagtgaaacacgcggtgccgaggtgcggcgcatcgccatccgcgcggcgtttactgctttcacggcattaatggcattacgttcaatgcacgggatttgtacctgtccggcaaccggatcgcaggtcagcccaaggttatgctccatcgcgatttccgccgcattgcatacctgcgccggactgccgcccagtagttcagttaaccctgccgccgccattgaacaggccacgccaatctccccctgacagccgacttccgcgccagagatggaggcgttcattttatacagcgcgccaatagcccccgcggccagaaaatagcgggcaattgaccgctcgtttaccggacgacggaacttatcgtaataagccagtactgccggaataatgccgcacgcaccgttagtcggtgccgttaccacgcgcccgccagctgcgttttcttcactaaccgccagcgcgtacatgttgatccagtcgatgacattcatcggatcgttagagatgttatcgctggaaaccagctgacgacgcagcgctacggcacggcgcggcacattgagcggaccaggcagcacgccttcagtgttcatcccacgttcaataccgtcatgcatcacttgccagatacgggcaaaaccggcgtcaatttccgctttgctgcgcagcgctagctcgttgtgcatcatcagaccagatatagacaggccgttgtaatcacacattttcagcagttcacctgctgagtggaaatcgtaaggtacggacgtttcgacatcgtgcgacaggccgaagtgttcttcttcgacaataaacccgccgccgacagagtaataggttttacttaatagctcttcctgtcccttccaggcagtgatccgcattccgttctcatggcgaggcaacatttcgggatggaagataatgttctttgctacaggaaaatcaacaatatgcgcaccagatgccactggcagccgcccgctgcgcgttactaactctataaatgcagggatctcatcaatgacaacatcctgcggactgtttcctgccagtcccatgatgatggcgacatccgtggcatggcctttgcccgtcagtgacaacgacccgtacagatcgaccacaatatggctcgtcgcggttaataagccgctactttccagccgatcaataaaactttttccggcattcattggccccacggtatgcgaactggagggaccaatcccaattttgaaaatatcgaatgcactaatcatatccacaccctcggattgccgttcagtgaagtggagcggaacgaccttacgaccgtcccgctcacgaggctttacgcactacgtactgcgatggcttcaatttccagcttcacatctttcggcaaacgcgcgacctgcacacagctccgggtcggataggtcgcctgatgctcatcgaagaactgcttatagacttcgttgatggtggcaaaatcattcagatcggtgataaacacggtcatcttgatgatatcgcccacgctcagcccggcagcaaccacgatcgctttgacgttttcgaggcttaaacgcgcctgatcttgcacatcagccgggatctcaccggtctgtgggcaaaccggtatttgcccggaggtgaagaccatgctgcctaaatcaacgccctgaacataagggccgattgcgcctggggcacgttgcgtttcgataatctttttcatacatcctccggcgtcagagcgcctgggtaaaggtacgtgaaataacatcctgttgctgttcacgggtcagtgcgttgaagcgcacggcgtagccagagacacggattgtcaggttaggatatttttccgggtgctcgatggcatccagcagcatttcccgattcattacgttgacgttgaggtgttgaccgccttcgacatccgcttcgtggtggaaatacccatccagcaggccgacaaggttggttttacgtactggatcttctttgcccagcgccgcaggaacgattgagaaggtgtacgagatcccatctttggcgtaggtgaacggcagtttcgccaccgacgtcaatgaggccacggcacctttgcggtcacgaccatgcatcgggttagcgcccggcgcgaacggtgttccggcgcgacgaccgtccggcgtattaccggttttctggccgtacaccacgttagaagtgatagtcagaatcgactgggtagggacggcgttgcgataggttggcagcgctttaattttcttcataaagcgttcaaccaggtcgcaggcaatgctgtctacgcgctcgtcgttgttgccgtactgcggatattcaccgtcgatttcaaagtccaccgccaggccgttttcgtcacggattggtttcacgcgggcatatttgatggcagacagggagtccgtcgccaccgacaggcccgcgatgccgcatgccatagtgcgatagacatcacgatcgtgcagcgccatcagcgaagcttcgtagctgtacttgtcgtgcatgtagtgaatgatattcagcgcgctgatgtactgcaccgccagccagtccatgaagtgatcgaggctgtccatcactttgtcgtaatccagcacgtcgtccatcagcggtgctgttttcggcccgacctgaatcttcagcttctcgtccaccccgccgttaattgcgtagagcagcgttttcgccaggttagcgcgtgcaccaaagaactgcatttgcttaccaatcaccattgggctgacgcagcaggcaatcgcgtaatcgtcgctgttgaagtcagtacgcatcagatcgtcattttcatactgcaaggaagaggtgacgatcgacacctgcgcggcatattttttgaaggcaatcggtaattcttccgaccaaagaatggtcaggttaggttccggtgccggccccatagtgtgcagggtgtgcaaatagcggaaggagtttttggtcaccagcgtacgaccgtccagccccatcccgccgatcacttccgtcgcccagattgggtcgccggagaacagcgaatcaaattccggtgtacgcaggaagcgtaccatacggatcttcatgatgaagtgatcgatcagttcctgtgcctgctgctcattgagtacgccagctttaaagtcgcgctcaatgtagatatcgaggaacgatgccgtgcggcccagcgacatcgcgccgccattttgcgatttcactgccgccagataagcgaagtagagccactgcaccgcttcctgcgcattctgcgccgggcgagagatatcaaagccatatttcgccgccatttcctgaatctgcaacagcgcatgacgatgctctgccagctcctcacgcagacggatggtggcttccagatcctcgcctttttccagacgagactggagatcggcaaattgcagttcgcgttcacgtaccagataactgatgccatacagcgctacgcggcgatagtcaccgataatgcgcccacggccatagccatctggtaaaccggtcagcacgccagatttacggcagcgcagcatatccggtgagtaaacatcaaatacgccctggttatgggttttacgcagatcggtaaacagatattcaaattcactgtccatttctcggccataggcgtggaatgaacttttaatcatattaatgccaccgaacgggtgtagcgcacgtttcaacggcgcatccgtttgcaggccaacaattttttccagcggctggttaatatatcccgcatcatgagcggtaattgtggtggcaatattggtatcgaaatcaaccggcgcgtgggttgcattttcgatacggatgccttccattactttttcccacaattccgtggtggcaggcgtcgcttcggcgaggaaagattcatcgccttcatacggtgtatagttatgttgaataaaatcgcggacattaatttcgtttttccagtccgtacctttaaagccaagccatgcgtcggcgtacagcttatcgctggtatcaatatctaccttcatgaaaaataatctctctacaatacttcaactaaattatgcaaattctgcgggcgcgttaactttgcctaaatgaatggcatccaaagcaatcattttttcttcgttagtcggaataacggcacaaatgacacgcgcattttcactggaaacaattcgctcaccacaggagttagagcgattattcatttctgtatcaatctctaagcctaatacagccaaatgttccatgaccagacgacgaattaagcttgaattctctcctattccgccggtgaatataattccatccaggcgacgtaatgaagctgcgtgtccggcaatatgacgggcaattcggtgaacaaaggttttaattgccagttgcgcgcgttcgtgaccttcatgccaggctttttccagaacacgtaaatccgaagaaagaccggaaatacctaataatcccgactctttattcactacgcgttccaggtcacccaggctctggttggtttggctggcgacccaggacatcgcaccaaagtcgacatcgccactgcgggtacccatcatcaagccttccagcggcgtcattcccattgaggtatcaacactctgaccgttgcgaaccgcgcagattgacgcgccattgccaagatgcgccacaaccaggccggagtcatcttccgccagattcagcagcgaatgtgcgcgctgggaaacatagcggtgcgacgtgccgtggaaaccataacggcgtacacctaactcttcataatatttccacggcaggccgtataaataagcttccggagccatcgtctggtggaaactggtatcaaataccgccacctgagttacgcccggaaataattgctgcgccgattcaataccacttaaattggcgtaattatgcaggggtgccagtggagaaacgcgacggatattatcaatgacttcatcggtaataatggcggactcggtaaaaatactgccgccgtgagcgatgcggtggccaattaaggccacactgtcatttaaattccgtttttccagttcaaatgcaattgccttcaatgcaccttcgtagctgtggtgagccagcggtgctggctctcccccatttacggataagaatgcattttccgagttaataccgtcggcaatacctgacattaatacttcacagtcgctggcatcgagcacggaaaacttaatcgaagacgaaccacagttaataaccaaaacaaccggaaattcattcatctcttttctcatcctgagttacggattaaaacagtttgtatacgatgttcaggatggtcagcagaccaatcacggtaacaaacacgttatccagacgaccacggtatttcgccagagacggcgctttacggatggcatacatcggcaacaggcacagcagggatgcgataatcggtgcgcccatggcttcaatcaggtcaaggatgttcgggttggcgtaggcaacaacccaggtggagcccatgatgaagatcatgctgatagtgttcagtttacccagcgacactttagttttgtcgcctttataaccaaacttcaggaccaggccattcagaccttccagcgttcccagatagtgaccgaagaaagatttgaagatagccacgagtgcgatgatggaagccgcatattccagtgtaatcgcgaacgttgttttggtaccggtcatggacgcaaagtggttagccagataagaaagcactggaatattctgcgctttggcttccgccatgttggccggagacagagtaaacaggcagctaaaggcaaagaacatcaccactgcaaccatcagcatgctggcacgagaaatgatttgggaacatttacgttcggtgaagtcgcgaccgaagtctttctcatactcttcacgcttagaaaccacgaaggaagagacgattggcgagaagttaaaggagaaaaccatgatggaaatccccagccagacagtgatcaggataccgtcatgaccggttaacgacagcgaaccgaggtcaacctggtcgataactgcagagttccagtaagggatcagcgacaaagaaatcagcaccaggctggcgataaacggccataccaggtagctcatcactttaaccatcagatccttaccaaaccagatgacgaaagccatcagcagcaacaggaacagcgccacaaagccgcgattcagcggtgcaaagccgagctggttttcccagaacgtcataaaggtattggtaatagtaacgccataaatccacagcagtgggcaaatcgcgaagaagtacaggaacgtgataaccacgccgccagttttaccaaaatgctcttccaccgtttccgtaatgttgccggaagggttagagccagaaagacacagacgcgccagcgcccggtggcaataaaacgcgatggggtatgccaataccaacatcagaagaatcgggatcagtccgccaaaacctgcgcggatagggaagaacagcaccccggcgccgattgccgtaccaaacaagcctaacgtccatgtggtatctgatttacgccaggacgattgttttgtctggctggatacaatgctatctgaagtactcatatcctatcctcaacgaattaattaagcgtcaacgaaaccggtgatttgagagacgcgagaaagatcgatattgccgccggaaataatactgacggtttttctgttttgaatatattggtctaatttaccgcttaataatgcagcacatgccagagcgcctgcgccttcggtgacgactttattgcgctgaattaaggcaatcatactgtttctgatttcgtcttcgctgaccagcacgatgtcatcgactaattcacgaacgatttcgtaagttaaattacccgggcgggagacatcacaaccatccgccagggtgccggtagttcggtgcgtggttatttctccggagtggaaagaagccgccatgccgtgaacgttttcagactgtacgccaataacacgaatggtcgggttaatagatttaattgccaccgcaataccagcaattaaaccgccaccaccaattggcacaatcacgttatcgacatcatagagatcttccataatttccagaccaatcgttccctggccagcaatcactttcggatcatcgtaaggtggaataaaaatacggccttccatttcgacaatttcgctcactttagcgatagtgtcgttgaagttatcaccatgcagaacgacttctgcggagtagtcgcacgttgccgctactttggattttggcgcaccttttggcatcaccactttaccgtcgatacccagcatcgcgcaggagagggaaaccccttgcgcatggttgcccgcagaacaggccaccacgcctttgcgtttttccgcatcggtcagtgaacttaatttattaaatgcgccacgaattttaaatgaacccgtacgctgcatattttcaaacttcaggaatatttcacctttgcaacgttcactaaaatagttggagcgaggcatgcctgttttataaattcgcccagccagtcgttgtttcgcttcaataatgtcatcaatagcaaccggcagatcgtatgtaatatgcattataaaacctcttcgcctgaattaaatatgtaggtaaccgtaaccgacacctgcaagacagacaggtggattatttatgtttaaataaaaacaaataactaaccaacttctattaattgccttcgtctacacccattataagatgaatactctttggctaattccaccaaaaccgatgctgcttttttaatacgataatttttcgaccataccgcggcatattgtgccacaggtaatgtttcttcaaccggaatagtaataaattgattagaaccaaaaggtgacgtcatatcacaaggaattacagttaagaaatcagcattgagaacaagattataaattgtcacgactgagtcggttttaacgatgttttcaatactgatgccatttctttgtaacgtagtaagcagttcgctgtagtaccccatattagtttgtggcaacacccactgttcgttcttcaacgactccagcgtggtggtgccggtgcatgttcgggacttactggctaccagcacaaactcggactcgaacagcggctcaacatgtaaatcctgaagcttcatttctgcacttaacgtaccaatcgcaaaatccagtcgaccgtcgcggattgccggtaagaacgaagacagttgcgcttcatacatagaaacctgcgctttcgggaacacctctttgaacttgttgatcatccctgacataaaagtaaaaccaatcaatgaaggaaaaccaaatgagacttccaccaccgcctcagaagacataccgcttatctcattaaccatatttttcatttcacgggtaatggattcggaacgggagagtaacaattgaccggcaggtgttaatgttacaccggtatttttccgcaccactaattccacaccaaaataatcttcaatatcgttaatgattttactgacggccggttgagttaaccctaattcttttgcagccgagccgatagaaccacttctaatgacttcctgaaagactaccaggtgctgcgttttcggaagaagaatagtgctcataacgacctacgttaattacctcattgacggcatgaagtgtatcaaaatgaaatgaacaggatatgtgcgaccactcacaaattaactttcaatactttccagagtatcgttattacaattaaatacctttaaatatcaacaagttaaagtataaaaatcagcataaaccctgatttttgtcaaaaaaaatgacggggataaccatattttatggcgataacatcattcgttatgtggttaatacaaaaaaggggctgagaccatatttcaagcaattaccggataattaccaggcaaaatttgagttaaatttaatgagcaagttctcaaattttattataaataaaccattttcagtgataaataatgcggcatgtcacattttttcacgctatttgttggagaacaaacatttattttatcaatattttaaaatttcgaatacatgtattgatcatctcgaacaattgattaacgtcaactttttctcttctgacaggacgtcattttgtgaatgcaatcgttttccataaattcttctcccctcataggcgacgaatagcattttgtgttgaggatcacaaaacgaataattgctgatcgccgcgataaggtcagacaaagacaacaagggaaattttcacagagcttttgatcggcgtaggccacagaatgttgcttcgtttactgtaacgccgggtaaatgagcgttttttgatagtgcgaaagaaccctgcgaggaaaataagcatctattattgtttgtcatgatgacaaggcaggcatcaatgaaaggcttcccaattgcgcatatttttcacccttcaatcccgccaatgcacgcagtggttaacaatcacaatagaaatattgattattggacggtaaaaagaaagtttgcagaaattgtctccaccaatgacgttaataaaatttacagtataagtaatgaactgcggagagtattatctgcaataactgcattgaatttctatcatggcgatgttccttctgtcatgatccgaatccaaccggaaaatatgagtccattcattatagatatttctacaggagaacatgatgattatatcatacaaacattagatgtaggcacttttgcaccttttggtgaacaatgtacttgctcagccgtcaataaaaaagagctggaatgtattaaggagacgatttctaagtattgtgcaaaattcacccgaaaagaagccatcttaacaccccttgtgcactttaataaaaccagcattacttcagattgttggcaaattctctttttttcacccgatcattttaataatgatttttattgattatttataaaggataaaataatgttccctgtttcatcaattggtaatgatattagtagtgatttagtccgtcgaaaaatgaatgaccttcctgaaagcccaacaggaaataacctcgaagcactagcaccaggtatagaaaaactaaaacagacctctattgaaatggtcactttacttaacacgttacaacctggtggaaaatgcattatcactggtgattttcaaaaagaattagcgtacttacaaaatgtaattctttataatgtctcgtctcttcgtctggattttttaggttataacgcccaaattattcaacgatcggacaatacttgtgaacttaccattaatgaaccgttaaaaaaccaggaaatatccacaggtaatatcaatattaattgcccattaaaagatatttacaatgaaatcaggaggttaaacgtaatttttagttgtgggactggagatatcgttgatctatcctctctggacttacgtaatgtcgatttagattattatgatttcacagataaacatatggctaatactattttaaatccttttaaattgaattcaacaaattttactaatgccaacatgtttcaggttaattttgttagttcaacacaaaacgccacaatctcctgggattatttactaaaaataacacctgttttaataagcattagcgatatgtattctgaagaaaaaatcaagtttgtcgaaagttgtttgaatgagcctggagacattaccgaagaacaattaaaaattatgagatttgcaattataaaatctataccaagagcaactcttacagataaattagaaaatgaattaacaaaagaaatatataaaagctcatcgaaaatcaacaattgcttgaacagaattaaattaccagagatgatagatttctcatcagaaaaaatacatgattatatcgacataatcattgaagattatgaaaatatcaaagaaaatgcttatctggtcattccccaaattaattatactatggatttaaacatagaagactctagctcagaagagttactttcagataatggtatcgagaaagacgataattcttctgacaattactttgaggtcgaaaaaatataacacacatgaagcatataactcagaggaactatattttaccagagaggactatacgtatgattacgaccttttaaatgcaatatagacttaataacttcttacaaagtctattattaataccgtaaatattcatgcttcttaccctgtgcaccaaaagcaaaaacttatcgatgcgggtttgaaactgatggcaaccgcaaaaatgcctgatgcgctacgcttatcaggcctacgccatctctgcaatatattgaatttgcgtgcttttgtaggcaggataaggcgttcacgccgcatccggcatgaataaagcgcactcaacaatctgaaacccgccggaacggtttattacgtacatcaggtgaaactgaccgataagccgctttcttttgggtatagcgtcgtggacagtcattcatctttctgcccctcccaaagcaaaaacccgccggtttacgctggcgggttttcgttaaatcaggtgaaactgaccgataagccgggttctgtcgtggacagtcattcatctaggccagcaatcgctcactggctcaagcagcctacccgggttcagtacgggccgtaccttatgaacccctatttggccttgctccgggtggagtttaccgtgccacggactgttaccagccgcgcggtgcgctcttaccgcaccctttcacccttacctgatcccgcttgcgcgggccatcggcggtttgctctctgttgcactggtcgtgggtttcccccccaggcgttacctggcaccctgccctatggagcccggactttcctcccctccgcccgtctcccccgaagaggacgacgacgaagcggcgactgtctggtcagcttcggcgcgcagtatagagggtttgcgcgcccttgtcaccccgcgttgcgcattccaatcgccagtgtcgcggcgatattacgtgaagcacggcagatattgtcataagccccgcggaatgcttcgtccaacgtacctatgctggtcaatacgctgaagaccgcatcaatgccatgctgatgtacaacgccaacatcatcggtcaggctacccgcaatgccaatcaccggtttatggtacttcttcgccacgtttgcgacaccaatcggtaccttcccgtgaatactctggctgtcaatacgcccttcaccggtgatcaccagcgtacaatcgtgaatatgttcctccagattcagcgccgtagtgacgatttcaataccacttttcagttccgcaccaagaaacgccattagcgccgcgcccataccacccgcagctcctgcaccggggacatctttcacatcaacatgcagcgcttttttaatgacctcggcatagtgagagaggttattgtccagctcaacaatcatcgcttcactggctcccttttgtgggccaaagatgcgcgatgcgccgttatcgcccaccagcggattggtgacatcacaagcgacgcgaatgacgcaatcttttaagcgcggatcgaggccggaaatatcaatatcattcagagtattaagactaccgccgccaaaaccaatttcattgccgttggcgtcgcataatttcgcccccagcgcctgtaccatgcctgcgccgccatcatttgtagcgctgccgccaatgccgataataatgtttgtcgcaccgctctccagcgcctgcaggattaactcgcctgtgccgcgtgaagtggtcacgagtggatcgcgtttttccgcaggtaccagctccagcccactggccgccgccatttcaataaacgcggttttgccatcgccggagatcccccaactggcattcactttctcgcccagcggccctgtaacccaggcgtgacgttcagccccctgggtggctgcaatcatcgcttccaccgttccttcgccaccgtcggcaaccggaacagaaacgtactgtgcatcaggaaaaatttcccgaaatcctttttctatcgcctgcgcaacctcgctggcagataaactttctttataagagtctggggcgattacgattttcatacctatgcctgttaccacatgacgccggagggcgtttctcttattcggcctggattccaggcccggattgcaatacgccatccgggcacgacgtcattaacgagtaacttcgactttcgccagtttttcgtagtagcacgccagggcgctatgatccgccgttcctaaaccatctgctcgcagtgcctgcatcatctccataaccgcagctgtgagcggcagttgtgcgccgacgccgtgagaagtatccagcgcattcgccagatccttaatatgcagatcaatacggaagcccggcttgaagttgcggtccatcaccatcggcgctttggcatccagcacggtactgcccgccagtccaccgcgaattgcctgataaaccaggtccgggttaacgcccgctttagttgccagcgttaacgcttctgacatcgcggcaatattcagcgccacaatgacctgatttgccagtttggtgacgttacctgcaccgatttccccggtatgcaccacggaacccgccatcgctttcatcaaatcatagtatttgtcgaaaatagccttgtcgccgcccaccatcactgacagcgtaccgtcgatggctttcggttcaccgccgctcaccggagcatccagcatatcaatgcctttcgctttcagcgcttcgctgatttcacggcttgccagcggtgcgatagaactcatatcgatcaataccgtacctggcttcgcgccttcaataatgccattctcacccagcgccacctctttcacatgaggggagtttggcagcatggttatgatgacgtcgcactgttcagcgatcgctttagccgtagacgctgtttctgcacctgcagcaatcacgtcagcaatagcttctgggttacggtcagcaaccaccagcgagtaacctgctttcagaaggtttttactcattggtttacccataatccccaggccaataaaaccaactttcatagtcatatcaatcatctctcttgttgcggtggtggttattttttaaaggtatcagccagtttctgagtggcagagcggaagacgccgagatcgctgccgacagccacaaacgtcgcgccccattccagataacgacgcgcatcggcttcgaccggcgcgaggataccgctgggtttgccgtgcgcgctggcacggttaaaaatgtgctgaattgctttttgtacatccgggtgtgatgcattgccgagatggcctaatgccgcggccagatcgctggggccgacgaagatgccgtctacgccttcggtagcggcaatggcatcgacgttatctacgccctgctgactttctatctggaccagaatagtgatgttcttgttcgactgagcgaaataatccgccacggtgccaaacatattggcgcggtgagaaacggagacgccgcgaatgccttccggtgggtaacgggttgatgccaccgccagctctgcttcctcttttgtttctacaaaaggaatcaggaagttatagaaaccgatatccagaagacgcttaataattaccggctcgttggtcggcactcgcactactggcgcgctggcgctgcctttcaaggccattaactgcggaataaacgtggagatatcgtttggcgcatgttcgccatccagcaccagccagtcaaacccagccaaaccaagaacttcagtgctaatcgggttagagagtgctgaccagcaaccaatttgtacctgtttcgcagccagtgcggctttgaatttattcgggaaaacatcgttattcatcgcttatacctttgcttatttctgcaattccatacgtttaatgtcgccaactacgaagaggtagcagaccatcgccatcagcgctgaacatcccacgaaaaccagtgctgcattgaaggagtgcagttcacttaccaggtagccaatcaccagtggagtgacaatggaggcaacattgccaaagacgttaaagacgccgccgcagaggccaacaatctctttcggcgcggtgtcagaaatcaccggccagcccagcgcaccaaatcctttgccaaagaaagccagcgccatcagcatgaccaccagcgtggtgttgttggtgtagttacataagatgatggtggaagccagcaacattcccagcacaatcggtagcttacgtgccagggtcagggataaaccgcgtttgatcagataatccgagaagacacctcccagcacgccgcccgcaaaaccacacagtgctggaatcgaggcgaccagacccactttcagaatcgacatgcctttttcctgcaccagataaatcgggaaccaggtgaggaagaaccaggtgatggtgttgataaaatattgtccgaaaaatacgcccagcatcatgcggttagagagcaattgcttgatgtaatgcagtttgggtccgcttgctgccgcactgcccggctttttgtggtccatatcgaccaccgcgccattttcagagataaacttcagctcttccgcagacatacgtgggtgatctgtcgggttatgaatcaacttgatccacagcgccgtcagcacaaaaccaatcacccccataacggtaaagacgtgctcccagccccaggcgaaagtcagccagccaagcagcggcgaaaagagcgccagcgagaaatattgcgccgagttaaagatggcggaggcagtaccacgttctttcgtcgggaaccaggcggcgacaattcgggcgttcgccgggaatgatggcgcttccgagaagccgagcataaagcgcataaagaacatggagatccctgcccaggccagcgggaacatatcaacaaagccttgcaggaaggtgaatagcgaccagaaaaagaggctgtaggtgtaaacttttttcgagccaaacttatcaagcagccagccgccggggatttgcatcagcaagtaggcccagccaaaagcggagaagatgtaacccatcgaaaccgcacttaactgcaactcttttgccacttcggtaccagcaatagacagcgttgcacgatcggcgtagttaacggcggtaacaataaaaataatcagtaatattaaatagcgggtatgcacgcctttctttttttcgtcaacggtgtccagaatcattttatttacctcgggtacttatgctgatttttattattatggggaaggtgttatttatgagtttcatttatgccgtaacgacaatgaactcgggaattagtataagcagcgcgagaataataatcattgtgcaaacgctaatttaattaatactatttaaatattattttgagcatatgcacataaggttgcgcgctaaagcacagatttgcgctttaccttaccgggcggcactgcaatccctgaaatgattgacattgatcacatttctgcgtttaaactcctgacattcttatttcacccaatgaagtcatttatttttaaatgagaccaggtcctcattttaataacccctggctggagaatattgcacaatggccaacatcgaaatcagacaagaaacgccaactgcgttttatataaaagttcacgacacagataatgtggcaattattgttaatgataatggcctgaaagcaggaacgcgttttccggatgggctggaattaattgaacatattccccaggggcataaagtcgcattgctggacattccggctaatggtgaaattattcgttatggcgaagtgattggttacgccgtgcgtgcaatctcacgcggaagctggatcgacgaatcaatggttgtactaccggaagcgccgccgttacacacgctgccactggcaaccaaagtcccggaacccttaccgccgctggaaggatacacctttgagggctatcgcaatgccgatggcagcgtgggcaccaaaaacctgctcggtatcaccaccagcgtccactgtgtggcaggcgtggtggactatgtagtaaaaatcattgaacgcgatctgctaccgaaatacccgaacgtcgatggcgtggtggggctgaatcatttgtacggttgtggcgtggcgattaacgcaccggcggcagttgtacctatccgtaccattcacaatatttcgctgaatcctaactttggcggcgaagtaatggtgattggcctgggttgtgaaaagttgcagcctgagcgcctgctgactggaacggatgatgtgcaagctattccagtagaaagcgccagcattgtcagtttgcaggatgaaaagcatgtcggttttcagtccatggtcgaggatattttgcagatcgccgaacgccatctacaaaaactgaatcaacggcagcgagaaacctgcccggcttcagaactggtcgttggtatgcagtgcggtggcagcgatgcgttttctggtgtaacggcaaacccggcggttggctatgcgtctgatctactggtgcgctgcggcgcaacggtgatgttttcagaagtaacggaagtgcgtgacgcgatccatctgctgacaccacgcgcagtgaacgaagaggtcggcaaacggctgctggaggagatggagtggtacgataactatctcaatatgggaaaaaccgaccgcagcgccaacccttcgccgggcaacaagaaaggcggtctggcaaacgtggtagagaaggcactcggctccattgctaaatcgggtaaaagcgcaattgttgaagtgctgtcgcccggtcaacgcccgactaaacgcggattaatttacgccgcgacgccagccagcgattttgtctgtggcacgcaacaggtggcttcgggtatcacagtgcaagtgtttacgaccggtcgtggtacgccgtacggcctgatggcggtacccgtcattaaaatggcaacccgcaccgagctggcgaaccgctggtttgatttaatggatattaatgcgggcaccatcgctaccggcgaagaaactattgaagaggtgggctggaagttgttccactttattctcgacgtcgccagcgggaagaagaaaaccttctcggatcaatgggggctgcataaccagctggcggtgtttaacccggcaccggtgacctgatttcttttggaacgtccctcgcaaaatatggccttagtgccatgtttttattgtttaaagcccccacgtccattaataatgcatttgcattaccttagttcaagcttataatttgagcagaaaacaggctgtaaaaggacagtgaatcatgcccgctaatgctcgctctcacgctgtactgaccactgaatcaaaggtcacgatacgcggacaaacaactatccccgcgccagtgcgtgaggccttaaaactgaagccaggccaggacagcattcattacgaaattctgcctggtgggcaagtctttatgtgtcgactgggagatgaacaggaggatcatactatgaatgcatttttgcgttttctggatgcagatatccagaacaacccgcaaaaaactcgtccattcaacattcaacaaggaaagaaacttgtcgctggcatggacgtcaacattgatgatgagattggcgacgacgaataatggattttccacaaagggttaatggttgggcgctatatgctcatccctgttttcaggaaacctacgatgctttagttgccgaagtcgaggcattaaagggaaaagatcctgaaaattatcagagaaaagctgccacaaagttattggcggtggtccataaagtgattgaggagcatatcacggtcaatccatcatcaccggcattccgtcatggcaagtcgttaggctctgggaaaaataaagactggtcacgggtaaaatttggtgctggtcgctatcgtctcttctttcgttacagtgaaaaagagaaagtcatcattctgggatggatgaacgatgaaaacacgctgcgcacctacggtaaaaaaacagatgcctataccgtattcagtaaaatgttaaaaagaggacatcctcctgccgactgggaaagcctcacccaagagacagaagaaaaccattgatggtgttcacaatgcccgccgaacgtattcgtgttgaccagcgggcaccctttctcactccccgaccagaatcacttcaaccccagcctttcgcagtccttccagactatccgcaggaatgccttcatcaacaatgatcatgtcgatacgttgagtatcaatgatcttatgtaaactggaacgattgaacttactggaatcggtgactacgatgatccgttccgcaacttcgcacatccggcggtttaaacgggcttcatcttcattatgcgtgctgacgccgcgctccagatcgatcgcatctacaccaagaaacagcatatcgaagtggtaattttgcagcgattgttcagcctgatcgccgtaaaaagattgcgactgacggcgcaaatgcccgccggtcatcagcagctcaacgccttccgcttccagcaaagcattagccacgttcataccgttggtcatcgcaattacgtcagtgtgcttgcgcatcagacgagcaatctcaaaagtggtggtcccggaatcgaggatcacccgatgacctggctgaatcaactcaacggcagctttcgcaacgctgcgtttcatcgcggtgttcagtgcgcttttatcttccactgatggctcgactgacggcgtcgtgctatcgcagatcaacgcgccaccataggcacgcacagcgatcccctgcttttccagaaacgccagatcgttgcggatcgtcacggtagatacgccatacaatgccgacagatcgttaacctgcacactcccttgctgtcgcagacgctgaatgatctgttctcgtcgctcgctggtgcctgtcactcgcttctcacctgaagcgtcggtattactcatagtaagtcctttcgtaaaactttcgtttcatttcgttttgcctattaacgcctttctattaagcaaatgcaagcccaccttgcccattgacgcaagctactctcgtttcagtgactttcattatgtttcttttgtgaatcagatcagaaaactattgtctttcgttttatttttatctcaccatgacgcagtatcaactgaaacaaaacgaaagattaatatcgcagtaatctgaactggagaggaaagtgaaacatctaacagaaatggtgagacagcacaaagcgggcaaaacaaatgcaatttatgccgtttgttccgcacatccgctggtgctggaagctgcaatccgctacgccagtgcaaaccaaacgccgttactgattgaagcaacctccaatcaggtagaccagttcggcggttataccggaatgacgcccgccgattttcgcggctttgtttgtcagctcgccgactcgttgaatttcccgcaggatgcgttgattctgggtggtgaccatctggggccaaaccgctggcaaaacctgccagccgctcaggcaatggccaatgccgatgatttgattaaaagctacgttgcggcaggattcaaaaaaatccaccttgattgcagcatgtcctgtcaggacgatccaattcccttaactgatgacatcgtggctgaacgcgccgcccgtctggcgaaagtggcggaagaaacctgtcttgaacactttggcgaagccgatctggagtatgtcattggtaccgaagtgccggtacctggcggcgcgcatgaaaccttaagcgagctggcggtcaccacgccggatgccgcccgcgccacgctggaagcccatcgtcacgcctttgaaaagcaaggtttgaatgccatctggccacgcatcattgccctggtggttcaacccggcgtcgaattcgatcacaccaacgttattgattatcagcccgccaaagcgagcgccttaagccagatggtcgaaaactacgaaacgctgattttcgaagcgcactctaccgattatcaaacgccgcaatcgctgcgccagctggtgattgaccactttgccattctgaaagttggcccagcgctgaccttcgccctgcgtgaagctctgttctctctggcggcgattgaagaagaactggtgccagcgaaagtctgttctggtctgcgtcaggtgctggaagacgtgatgctcgaccgcccggaatactggcaaagccactaccacggtgacggcaacgcgcgtcgtctggcgcgtggttatagctactcggatcgcgtgcgctattactggccggacagccagattgatgacgctttcgctcatctggtacgtaatctggcggattcaccaattccgctgccgctgatcagccagtatctgccgctgcagtacgtgaaagttcgctccggcgagctgcagccaacgccacgggaactcattatcaaccatattcaggacatcctggcgcagtaccacacagcctgtgaaggccaataagcaaaacaaagaggaacacgctatgccaaatattgttttaagccggattgatgaacgcttgattcacggtcaggtcggcgttcaatgggtcggatttgcgggggcaaatctggtgctggtagccaacgatgaggttgccgaagatccggtacaacaaaacctgatggaaatggtactggcagaagggatcgccgtacgtttctggacgctgcaaaaagttatcgacaacattcatcgcgccgccgatcgacagaaaatcctgctggtttgtaaaacacccgccgatttcctgacgctggtgaaaggtggcgttccggtgaatcgcattaacgttggcaatatgcactacgccaatggcaaacaacaaatcgccaaaacggtttctgtggatgcgggcgatatcgcagcatttaacgacctgaaagccgctggggtggaatgcttcgttcagggcgtcccgacagagcctgctgtggacctctttaaattactttgagggattcatcatggaaatcagcctgttgcaggcatttgcgttgggcattatcgcctttatcgctggcctggatatgtttaacggcctaacacatatgcaccgcccggtggtcctcggcccgttggtcgggctggtacttggcgatctgcataccggaattttaaccggcggtacgctggaactggtgtggatggggctggccccgctggcgggcgcacagccgcctaacgtgattatcggtactatcgtcggcacggcgtttgccattactactggcgtgaaacccgatgtcgcagtcggtgtcgccgtacctttcgctgtcgcagtacagatggggattaccttcctgttctcggtgatgtccggcgtgatgtctcgctgcgaccggatggcagagaacgccgatactcgcggcattgaacgcgtgaactatctggcactgctggcactcggcactttctattttctctgcgctttcctgcctatctacttcggcgcggaacatgcaaaaaccatcattgatgtcctgccgcaacgattaatcgacggcctcggcgtcgcgggcggcatcatgccagcaatcggttttgccgtgctgctgaaaatcatgatgaaaaacgtctacatcccctacttcatcctgggctttgttgccgcagcctggctcaagttaccggtgctggctattgctgccgctgcgctggcgatggcgctgatcgacctgctgcgtaaatctcctgaaccgactcaacctgcggcacagaaagaggaatttgaagatggcatctaatcaaaccaccctgccgaacgtcagtgaaaacgaagaaacattgctgactggcgtcaatgaaaacgtgtatgaagatcagagcattggcgcggagctgacgaaaaaagatatcaaccgcgtcgcctggcgttccatgctgttacaagcgtcttttaactacgaacgtatgcaggcttctggctggttgtacggtctgctgcctgctctgaaaaagatccacactaataaacgcgacctggcgcgcgccatgaaggggcatatgggtttcttcaatacccatccgtttctggtgacatttgttatcggcattatccttgcgatggagcgttctaagcaggacgttaacagtattcagagcaccaaaattgccgtcggtgcgccgctcggcgggattggcgatgcaatgttctggctaacgctactgccgatttgtggcgggattggagccagtctggcattgcaaggctccattcttggcgcagtcgtctttattgtgctgttcaacgtggtacacctggggctgcgttttggtctggcgcattatgcttaccgcatgggcgtggcggcgattccactgattaaagcgaataccaaaaaagtcggccatgctgcgtctatcgttgggatgacggtaatcggtgcgctggtggcaacctatgttcgtttaagcaccacgctggaaatcacggcgggcgacgcagtggttaagttacaggctgatgttatcgacaaactgatgccggccttcttaccgttggtctacaccctgaccatgttttggttggtacgccgcggctggagtccgctgcgtctgattgcagttaccgtggttctcggcatcgtcggtaaattctgccatttcctttaaatacaatgaggtattagatgttaagtattattttgacagggcatggcgggtttgccagcggcatggaaaaagcaatgaagcaaattctcggtgagcaatcgcagtttatcgccatcgattttccggaaacctcaagcaccgcgctgcttacatcgcagcttgaagaggccatcgcccaactggattgtgaagacggcattgtttttctgacggatttgctgggcggcacgccgtttcgcgtagcttcaacgctggcgatgcaaaaaccgggctgtgaagtgatcaccggcaccaatttgcaactgctactggagatggtgctggagcgcgaagggttaagcggtgaagaattccgtgtacaggcactggagtgtggacatcgtgggctgaccagtctggtggacgagttaggccgctgccatgaagaatgtccggtcgaggaagggatatgacacacgttctgcgcgccagaaggctgctgactgaagagggatggctcgatgaccatcagttgcgtattgctgacggtgtcatcgcagcaatcgaaccgattccagtgggcgtgactgaacgcgatgcggaactgctctgccccgcttacatcgacacccatgtacacggtggtgcgggcgttgatgtaatggatgacgcgccggatgtgctcgacaagctggcaatgcacaaggcacgcgaaggtgtcggcagttggttaccgactaccgtaaccgcgccgcttaataccattcatgcggcgctgaaacgtattgcgcaacgttgccaacgcggcggacctggtgcgcaagtgctggggagttatctcgaaggaccgtacttcacgccgcagaataaaggcgcgcatccgccggagttgtttcgcgagcttgaaattgccgagctggatcaattgattgccgtttctcagcacaccttacgcgtggtagcgctggcaccggaaaaagagggggcattgcaggccatccgccatcttaaacagcaaaatgtacgagtgatgctggggcatagcgcggcgacctggcaacaaactcgcgccgcgtttgatgctggtgccgacggcctggtgcattgctataacgggatgacaggtttacatcaccgcgaaccgggaatggttggcgcgggattaacggacaagcgcgcctggctggaactgatagccgatggtcatcatgtgcatccggcggcgatgtcgctgtgttgttgctgtgcaaaagagagaatcgtgctgatcaccgacgcgatgcaggcagccgggatgccggatggtcgctatacgttatgtggcgaagaagtgcagatgcacggtggcgttgtccgtacagcgtccggtgggctggcgggcagtacgctgtctgttgatgcggcagtgcgcaacatggtcgagttgacgggcgtaacgcctgcggaagccattcatatggcatcgctgcatccggcgcgaatgctgggtgttgatggtgttctgggatcgcttaaaccgggcaaacgcgccagcatcgttgcgctggatagcgggctgcatgtgcaacaaatctggattcagagtcaattagcttcgttttgatagtttgctcctttattgggccttcacttcccccgtaaggcctttctttttctttcgttttgatctgtgcagcggtgtcggatgcgacgctaacgcgtcttatgcgacctacggtacgccgcatccagcaatcggtgaacatagcgacgtcattacgcaattctttaatcttcccttgtcttttctttcaatgatcacagatttcgttttatttcctttttctccattgaactttcgatttcttttctatagattttaatcaacgaaagacatcaccaagtgaaatgaaacgaaaggcaagtgaaagcgacaacgcccgacgtcaagttcatcagactaaggattgagttatgccaaaaaattacacccctgctgccgccgcaaccggtacatggactgaagaagagatccgccatcagcctcgcgcatggatccgttcactcaccaacatcgacgcgctacgttccgcgctcaataacttccttgaaccgttactgcgcaaagagaatctgcggatcatcctgaccggagccggaacctcggcatttatcggtgacatcatcgcgccgtggctcgccagccataccggtaaaaacttcagcgccgtaccgaccaccgatctggtcactaatccgatggactacctgaacccagcccatccgctgctgttgatctccttcggtcgatccggcaacagcccggaaagcgtcgcagccgtggaactggcaaatcaatttgtaccggaatgctatcacctgccgatcacctgcaacgaagcgggcgctctttaccaaaacgcgatcaacagcgataacgcgtttgccctgctgatgcccgcagaaacgcacgatcgcggctttgcgatgaccagcagcattaccaccatgatggccagctgcctcgcggttttcgcacctgagacgatcaacagccaaaccttccgcgacgtggcggatcgttgccaggcgatcctgacctcactgggcgatttcagcgaaggtgtgtttggttacgcaccgtggaaacggatcgtttatctcggtagcggtggcttacagggcgcagcacgcgagtcggcgctgaaagtgctggaactgacggcgggtaaactggcggccttttatgattctccaaccggattccgtcatggaccaaaatcgctggtcgatgacgaaacgctggtggtggtatttgtctccagccacccttacacccgtcagtatgatcttgatctgctggctgaacttcgccgtgacaaccaggcaatgcgtgtaatcgccatcgccgcggaaagcagcgacatcgtcgctgccggtccacatatcatcctgccaccgtcacgtcactttatcgacgttgagcaggcattttgcttcctgatgtacgcccagacgtttgcactgatgcagtcgctgcacatgggcaatacgccggataccccatcagccagtggcaccgttaaccgcgtggtgcaaggcgtaatcattcatccgtggcaggcataagaggatcgcattatgagcattatctccactaaatatctgttacaggacgcccaggccaatggctacgcggtgcctgcttttaacattcataacgccgagacgatccaagcgatcctcgaagtgtgcagtgaaatgcgatcgccggtgatcctcgccggaacgccggggacctttaaacacatcgcgctggaagagatctacgccctgtgtagcgcctattccacaacctacaacatgccactggcgctgcatctcgaccaccacgaatcgctggatgatattcgccgtaaagtccacgcaggtgtgcgcagtgcgatgatcgacggcagccacttcccgtttgccgagaacgtgaagctggtgaaatcggttgttgacttctgccactcacaagattgcagcgtggaagcagaactgggccgcctgggcggtgttgaagatgacatgagcgttgacgccgaaagtgcattcctgaccgatccacaagaagctaaacgctttgtcgaactgactggcgtcgacagcctggcggtagcgattggtacggcgcacggcttatacagcaaaacgccgaagattgatttccagcggctggcggaaattcgtgaagtggtggatgttcctctggtgctgcatggtgccagcgatgttccggatgaatttgtccgtcgcactattgaacttggcgtcacaaaagtgaacgttgccacagaattaaaaatagccttcgctggcgcggttaaagcctggtttgcggaaaatccgcagggtaatgatcctcgttattatatgcgcgtcggaatggatgcgatgaaagaagttgtcagaaataaaattaatgtctgtggttcagcgaatcgaatttcagcataatcattagttttttatgatttatcccaatgtacttcccgattaatatcggggagtgccttaatggaaaaggagataactaaaccttaataaatacatcagtacaatatcgcaacaataatatatttaaaaaaattatattattcaactttatggtgaggattacacaatgagcagtccaaatattctcttaacccgtattgataaccgtctggttcatggccaggttggcgtgacctggacatccaccatcggtgcaaatctgctggtagtcgtggatgatgttgtcgctaacgatgatattcaacagaaattaatgggtattaccgcggaaacctacggctttggcattcgtttctttactatcgaaaaaaccattaacgtcatcggcaaagctgcaccgcatcagaagatcttcctgatttgccgtacgccacaaacggtacgtaaattggtagaaggtggcattgacctgaaagatgtcaacgtcggcaatatgcatttctcggaagggaaaaagcaaatcagcagtaaagtttatgtcgatgaccaggatctcgcggacttacgttttattaaacaacgtggcgtgaatgttttcattcatgacgtccctggcgatcaaaaagaacaaatccctgactaaatctaaaatcgccttaatattggtttgaggtaataaaaatgcatgaaataaccctacttcagggattatccctggcggcgttagtttttgttctggggattgatttttggctggaagccttatttttattccgcccgataatcgtttgtaccctaactggcgctattctcggtgatattcagactggcttaattaccggtggtctgacagagttggctttcgccggattaacccctgcaggtggtgttcagccgcccaacccgattatggcgggtctgatgaccaccgtcattgcatggtctacgggcgttgatgccaaaacagcaattggtcttggcctgccgtttagtttgttaatgcagtacgtcattctgttcttctattccgctttctcattatttatgaccaaagccgataaatgcgcgaaagaggcggatacggcagcgttttcccggcttaactggacaacgatgctcatcgtcgcttcagcgtatgcggtgattgctttcctctgtacttacctggcacagggggcgatgcaggcgctggtgaaagcgatgcccgcctggctgacccacggctttgaagtggcaggcggtattctgcctgccgttggttttggcttgctgctgcgcgtaatgttcaaagcgcaatatatcccttacctgatcgccggtttcctgtttgtttgctacatccaggtcagcaacctgttgccggttgccgtactgggcgcaggctttgcggtgtatgagtttttcaatgcgaaatcccggcagcaagcgcaaccgcagcccgttgccagtaaaaatgaagaagaggactacagcaatgggatctgaaatcagtaaaaaagatatcacccgtctgggctttcgttcgtcgctgctgcaagcgagctttaactacgaaaggatgcaggcgggcggttttacttgggcgatgttgccgatcctgaaaaagatttataaggacgacaaaccgggcttaagcgcggcgatgaaagataacctcgaatttattaatacccacccgaatctggtcggattcctgatggggttattaatttcgatggaagaaaaaggagaaaaccgcgacaccattaaaggcctcaaagtggcactgtttggcccaatcgccgggattggcgatgcgattttctggtttactttgttgccgattatggcgggaatttgctcatcatttgccagccagggaaacctgctggggccgattctatttttcgccgtttacctgcttatctttttcctgcgcgtcggctggacccacgtcggttattcagtcggcgtgaaggcgatcgataaagtgcgagagaactcgcagatgattgcccgttcggcaaccatcctcgggatcacggtaatcggcgggctgatcgcttcgtatgtgcatattaacgtggtgacatcgtttgccatcgacagtacccacagcgtcgcgctgcagcaggatttcttcgataaagtcttcccgaacattttaccgatggcctacaccctgctgatgtattacttcctgcgggtgaaaaaagcgcatccggtgctgttaatcggcgtgacttttgtgctctctattgtttgttccgcattcggcattttgtaaatggaacgaggcactgcgtctggtggtgcctctttacttaaggaatttcatcctgtgcaaacccttcagcaagttgaaaactatacggcgttaagtgaacgtgccagcgaatatttattggccgtgatccgtagcaaaccggatgccgtgatttgcctggcgaccggagccacgccattactgacgtatcattatctggtagaaaaaatccaccagcagcaggttgatgtcagccagctcaccttcgtgaagctcgacgaatgggtggatctgccattaacgatgcctagtacctgcgaaactttcctgcaacagcatatcgtgcagccgctggggctacgtgaagaccagctcatcagctttcgctccgaagagataaatgagacagagtgcgaacgggtaacgaacctgattgcgcgcaaaggcggtctggatttatgcgttctcggattggggaaaaacggtcatcttgggctgaacgaaccgggagaaagcctgcaaccggcctgccatatcagtcaacttgatgccagaacacagcaacatgagatgttaaaaaccgcgggtcgccccgtgactcgtgggatcaccttaggcctgaaggatattctcaatgcccgcgaagttttgttactggtgactggcgaaggaaagcaggatgcgacagatcgttttctcacggctaaagtctctaccgctatcccggcttcatttttatggctgcacagtaactttatttgtttaattaacacctaaccagatgaaaaatttgctcaaaatgtttaaattaacttatgtaacagtcacgcattatattaaataacatttgactgggttgaacataacgccgatagcaaaaggagttatgttcaacaatttaattttagatatacatataacttgttctattaataaatcacctcgtattctgactcgccccctggcgcagcaaagtcaggcatttatactcttttgaatacatagaaaattgatatcaatataattaaaatatcaaatatttgcatataaatataatcttaaagttcagtctatttaatgttcaatgaaatatttctgcctgtataatctttaaagatgttgaacatatattcacattaaatatgattatgtacttgttacaaggataaggttatatatgaataaaggtacaaaaatagccattgcgggcttacttgcgcttttcgcaggtaatgccgctgcaacagatggtgaaatagtttttgatggcgagattttaaaatccgcttgtgaaatcaatgactctgataagaaaattgaagttgctcttggtcactataatgccgaacagtttcgttctgttggcgatcgtagcccaaaaattccattcactattcctttagttaactgcccaatgactgggtgggagcacgataacggcaacgttgaagcgtctttccgtctatggctagaaacgcgggataatggtaccgttcctaacttccctaatctggcaaaagtaggctcttttgctggcatagcggcaacaggtgtgggtatccgtattgacgatgcggaaagcggaaacattatgccactgaatgctatgggcaatgataacacggtttatcagatcccggcggactccaatggtattgtcaatgttgacctcatcgcttactacgtatcaaccgttgaagcatcagaaatcaccccaggggaagcagacgctgtcgttaacgtaacgctggattaccgttaatacgttacggcgttatctgacctgtcagataacgcccttttccttcctctttctcgttgtatcaggttgaaaaatgactatgtcaaaacgaacattcgcggtgatattaaccttgttgtgtagcttctgtattggccaggcgcttgcaggaggaatcgttttacagcgaacgcgagtgatctatgatgccagccgcaaagaggctgcgttacctgtcgcaaacaaaggcgcagaaacgccttatttactgcaatcatgggtagataatatagatggtaaaagccgtgccccatttattataaccccaccgctatttcgtcttgaggctggcgatgactcatcactgcgaattattaaaacagctgataacctgcctgaaaataaagagtcgctgttctacattaatgttcgtgccattccagcaaagaaaaaatcagatgatgttaatgctaacgagttgacgctggtatttaaaacacggatcaaaatgttttatcgccccgcacacctgaagggacgggtaaacgatgcgtggaaatcactggaatttaaacgtagtgatcattcactcaatatatataacccaactgaatattacgtcgtatttgccggattggcagtcgataaaatcgatctcacaagcaaaattgaatatatcgcgcccggagaacataaacagttaccacttcctgcatctggcggaaagaacgtgaaatgggctgcgatcaatgattatggcggcagttccgggacagaaactcgtccactgcaataacaaatataaaaaacacaggtcatcagggaatgccacaacgacaccaccagggacataaacgcacaccgaaacagttggcgctcattatcaaacgctgtttgccgatggtgctcactggcagcggcatgctttgcactaccgctaacgccgaagagtattatttcgaccccattatgctggaaaccacaaaaagtggtatgcaaacaaccgatctgtcacgattttcaaagaaatacgcacaactaccaggaacttatcaggttgatatctggctgaataaaaagaaggtttcacagaaaaaaattacatttaccgccaatgcagagcaacttctgcagccacagtttacggtagaacaactacgtgagctgggtattaaggtggatgaaatcccggcgctggctgaaaaagatgacgatagcgtgatcaactcgcttgaacaaatcattcccggtacagctgctgaatttgatttcaatcatcagcgacttaatttgagcattccccaaattgcactgtaccgtgatgcaagaggttacgtctccccttctcgttgggacgatggtataccaacgctgtttaccaactactcgtttacaggttctgataactgttaccgccagggcaatcgtagccaacgacagtacctgaatatgcaaaatggtgctaattttggcccctggcgattacgcaactattccacatggacacgcaacgatcagacatcaagctggaataccatcagtagttatttacaacgtgatatcaaggcattgaagtctcagttgcttctgggagaaagcgccaccagcggcagtattttttccagctacacctttactggcgttcaactcgcttccgacgataatatgctgccaaacagccagcgcggatttgccccaacggtacgcggtatcgcaaacagtagtgcaatcgtgactatcaggcaaaatggttatgtgatctatcaaagcaacgtgccagcgggtgcctttgaaattaacgatctctacccctcttccaacagcggcgatttagaagtcacgattgaagaaagtgacggtacgcaacgtcgctttatccagccttattcttcattacccatgatgcagcgacctgggcatctaaagtatagcgcgaccgctggacgctatcgcgctgatgcaaacagtgatagcaaggaacccgaatttgctgaagccacggcaatatatggtttgaataatacttttacgctgtatggcggcctgctcggttctgaagattattatgcgctggggatcggtatcggcggcacacttggcgcactgggcgcgttgtcgatggatatcaacagagctgacacccaattcgataaccagcactcttttcatggctatcaatggcgtacgcagtacatcaaagatatcccggaaaccaacaccaatatcgctgtcagctactatcgctataccaacgatggctattttagttttgatgaagccaatacccgtaattggaactataacagtcgccaaaaaagtgaaattcaattcaacatcagccagacaatatttgatggggtaagtctgtatgcctccggttcgcagcaagactattggggcaataacgataaaaacaggaatatctctgttggggtttccggccagcaatggggagttggttacagcctgaattatcaatacagccgctacactgatcaaaataatgaccgcgcactctctttgaatctcagtattccgttagaacgctggttaccgcgtagccgggtttcctatcagatgaccagccagaaagatcgcccaacccaacatgaaatgcgtcttgatggctcactgctggatgatggtcgcctgagctatagcctggaacaaagtctggatgacgataacaaccataacagtagcctgaacgccagttaccgttcaccttatggaaccttcagtgccggatacagctacggtaatgacagcagccaatacaattacggcgttaccggcggcgtggttatccatcctcatggcgtgacgctctcgcaatatctgggcaacgcttttgcgcttatcgatgctaatggggcttctggcgtgaggatacaaaactatccggggattgctaccgatccctttggctatgcagtggttccttatctcacgacttaccaggaaaaccgtctctcggtagatactacgcagctgcccgataacgtcgatcttgagcaaacaacacagtttgtggtgcccaacagaggtgcaatggtagcggcgcgtttcaacgccaatatcggttatcgcgtacttgttacagtcagcgatcgcaacggtaaaccgttgccctttggcgctcttgccagcaacgatgagacggggcaacaaagtatcgtcgatgagggcggcatactatatctctctgggatatcgagtaaatcacaaagctggactgtacgctggggaaatcaggcagatcaacaatgtcagtttgcttttagtacaccggattcagaacccacaacctctgtattacaaggcacggcgcagtgccattaaggataaaaaaatgaaaagagcgcctcttataacaggacttttgttgatatccacatcctgcgcttatgcctcctcaggagggtgtggagccgatagcactagcggtgcgacaaattacagcagtgtggttgatgatgttacggtgaaccagacagataacgtgacaggacgggagtttacctctgcaacgctaagtagcactaactggcaatacgcctgttcctgctctgcgggtaaggcagttaaacttgtctatatggtcagccccgtacttaccaccactggacatcagacaggatattacaaactcaatgacagcctggatattaaaaccacattacaggcaaacgacattccaggactcacaaccgaccaggttgtctctgttaacacccgattcacacagataaaaaacaacacggtatattctgctgcaacccaaacgggtgtttgccagggtgatacgtctcgttatggacccgttaatattggtgcgaacaccacctttaccctgtatgtcaccaagccatttctcggctcgatgaccattccgaaaacggatattgccgtcattaaaggcgcgtgggtcgatggaatgggaagcccgtctacaggtgacttccatgatttagtcaagttatcgattcagggaaatctcaccgccccacagtcgtgcaaaattaatcagggcgatgttattaaggttaattttggattcatcaatggtcagaagtttaccacccgcaatgccatgccagacggttttactccagtagactttgatatcacttatgactgtggtgatacttcaaagattaaaaactcgttgcaaatgcgcatcgacggtacaactggggtagtagaccagtacaacctggtcgccaggcgaagaagttcagacaatgtgcccgatgtcggtattcgtattgaaaatctcggcggcggagttgcaaatattccttttcagaacggtatccttcccgttgatccttccgggcatggcaccgtcaatatgcgcgcctggccagttaatctggtcggtggtgagctggaaacaggaaaatttcagggcacagccaccattaccgtcatcgtgcggtaaaagaagacgttgcgttttgattaacgcaacgcttcggcactgttacccctgctgctccagcgcatacttatacagcgcatttttcttcacgccgtgaatttctgcggccagcgccgccgcttttttcagcggcagttctgcctgtagcagcgccagcgtgcgcagggcatcggcgggtaagtcttcttcctgtgctttatgaccttcgacaatcagcaccatttcgcctttgcgacggttttcatcttcctttacccacgccagcagctcgccaacgggcgcgccgtgaatggtttcccaggttttggtcagctcacgcgccagaaccacgtagcgggattcgcctaataccgcaacgatatcttccaggctatctaacagacggtgggtagattcataaaaaatcagcgtgcgcggctccgcttcaatggcttttagcgcatcacggcggccttttgatttggcaggtaaaaagccttcgtaacagaaacggtcagagggtaaacccgctgcgcttaacgcagtgatagcagcacacggcccgggtagcggcaccacgcggatccccgattcacggcaggtacgcaccagatggtagccaggatcgttaattagcggcgttccggcatcggaaaccagcgcaatgttttgcccctcttgcagcttcgccagcagcgtttcagctttttgttgttcgttatggtcgtgcagcgcaaacaaccgggcattaatcccaaaatgttgcagcaataaaccggtgtgacgagtatcctcggcggcaatcagatcaacggcctgtaatacctctaacgcacgctgggtgatatccgccagattgccgattggcgtcggtacaatgtaaagctggccctgagaattatccgccgattggtgttgtttcattgtgtcgtccgtattgccgatttaatattgagcattgcgtaaaaaaaatatcactggatacattatggtaccctcaacattttctcgtttgaaagccgcgcgttgtctgcctgttgttctggcagccctgattttcgccggttgtggcacccatactcccgatcagtccactgcttatatgcagggtacggcgcaggctgattctgccttttatcttcagcagatgcagcaaagctctgatgataccaggatcaactggcaattactcgccattcgtgcactggtgaaagaaggtaaaaccgggcaggcggtggagttgtttaaccaactaccgcaagaactgaacgatgctcagcgccgcgagaaaacactgctggcggtagagattaaactggcgcagaaagattttgctggcgcgcaaaacttgctggcgaaaatcacacctgccgatttagaacaaaaccagcaagcccgttactggcaggcaaaaatcgatgccagccaggggcgtccttccattgatttactgcgcgcgttaattgctcaggaaccgctgctcggcgcgaaagaaaagcagcagaatattgacgccacctggcaggcgctctcctccatgactcaggaacaggcgaatatgctggtgatcaacgccgacgaaaatattctgcaaggctggctggatctgcagcgcgtctggtttgataaccgtaacgatcccgacatgatgaaagccgggatcgccgactggcagaaacgttatccgaacaacccgggcgcgaaaatgctgccaacgcagttggttaacgtaaaagcgtttaaaccagcctcgaccaacaaaatcgccctgctgttgccactgaatggccaggcagcggtatttggtcgcactattcagcaaggctttgaagcggcgaaaaatatcggcactcagccagtggcagctcaggtagctgccgcacctgccgcagacgtagctgaacaacctcagccgcaaaccgtggatggcgttgccagcccggcacaagcctcggttagcgatctgaccggtgaacagcctgcagcccagccggtgcctgtaagcgccccggcgacaagcaccgcagcggtaagcgcacccgcaaatccatccgcagagctgaaaatctacgatacctcatcacaaccacttagccagatcttaagccaggttcagcaggatggcgcgagtattgtggtcggtccgttgctgaaaaataacgttgaagagttgctgaagagcaacactccgctgaacgtactggcactgaaccagccggagaatatcgaaaatcgcgtcaatatttgttacttcgcgctttcaccggaagacgaagcgcgcgatgcagcgcgtcatattcgtgaccagggtaaacaagcgccgctggtgctgatcccacgcagttcattgggcgatcgcgtagccaatgcgtttgcgcaagagtggcagaaactgggcggcggcaccgttctgcaacaaaaatttggttccaccagcgaattacgcgcgggtgttaacggcggttctggtattgctttaacgggtagcccgattactctcagagcgacaaccgactccggcatgacgaccaacaatccaacgctgcaaaccacgccaaccgatgaccagttcaccaataatggcggtcgtgtcgatgcggtgtacattgtggcaacgccgggtgaaatcgcttttatcaaaccgatgatcgccatgcgtaacggtagccagagcggtgcaacgctgtacgccagctcccgcagtgcgcaagggaccgctggcccggatttccgactggagatggaaggcttgcagtacagcgaaatcccgatgctggcaggcggtaatctaccgttaatgcagcaggcactcagcgcggtgaataacgattattcactggctcgcatgtatgcgatgggcgtcgatgcctggtcgctggcaaatcatttctcacaaatgcgccaggttcagggttttgaaatcaacggtaataccggaagcctgacggctaacccggattgcgtgattaacaggaagttatcatggctacagtaccaacaaggtcaggtagtccccgtcagttaaccaccaaacagaccggcgatgcgtgggaagcacaagcgcgtcgctggctggaaggcaaatgactgcggtttatcgccgctaacgtgaacgagcgtggcggcgagatcgatctgataatgcgtgaaggccggaccaccatttttgtcgaggtacgctatcgccgctctgcgctttatggcggcgcggcagccagtgtgacccgcagcaaacaacacaaattattacagactgcccgcttgtggctcgcgcgtcataatgggagttttgatactgtggattgccggttcgatgtggtagccttcaccgggaatgaggttgagtggattaaggatgcctttaatgaccactcataattaaggtttaaggattagcgtgcaagaaagaattaaagcttgcttcactgaaagcattcaaactcaaattgcggcggcagaggcgcttccggatgccatctcccgtgcagccatgacgctggttcagtctctgctcaatggcaacaaaatcctctgttgtggtaatggaacttccgctgccaatgcacagcattttgctgccagcatgatcaaccgtttcgaaacggagcggcccagcttacctgccattgcactaaatactgataatgttgtcttaacggcgattgccaacgatcgcttacatgatgaagtgtatgcaaaacaggtgcgggcgctgggtcatgcgggagatgtattgttagccatttccacccgtggcaacagccgcgatattgtaaaagcggtagaagctgccgttacgcgtgatatgaccattgtggcattgaccggctatgacggcggcgaacttgcaggtttgttagggccacaagatgtggagatccgcattccttcgcatcgtagtgctcgcattcaggaaatgcatatgctgacggtaaattgcctgtgcgatctgatcgataacacgcttttccctcaccaggatgattaaggagaatacatgaaggcattatcgccaatcgcagtccttatttccgcgctgctgttgcaaggttgtgttgccgctgccgtagtgggtaccgctgctgtgggtaccaaagccgcaactgacccacgcagtgtcggcacccaggtggacgatggtaccctggaagtgcgcgtgaacagcgcattgtcgaaagacgaacagattaagaaagaagcgcgcattaatgtaacggcctatcagggcaaagtgctgctggttgggcagtcaccaaatgctgaactttcggctcgcgccaaacagattgctatgggcgtagacggtgccaacgaagtgtataacgagattcgtcagggccagccgattggtctgggcgaagcatctaacgatacgtggatcaccaccaaagtgcgttcgcagctcttaaccagcgacctggtgaaatcgtccaacgtgaaagtgaccaccgaaaacggtgaagtgttcctgatggggctggtgactgaacgtgaagcgaaagcggcggcagatattgccagccgggtgagcggcgtgaagcgggtaactacggcgtttacgtttattaaatagcagccccttgtaatgcctgatgcgacgcttgccgcgtcttatcaggcctacaacgatacaaaccgtaggtcagataaggcgtttacgccgcatccgacatgttttccctcaaatcagaacaacagcgccagcccgccgacaatcacaccagacactgccaccatcgcccccatcagccataaggctttcgccgggaacgctttgcgcagcataatcagtgacggcaaactcaccgccgggagcgtcatcaacaatgccagcgccggagcggttcccatacctgccagcatcatcgtttgtacaatcggaatttctgctgccgtgggaatgacaaacaagcatcctgctaccgccatcgccaccacccacatcaggctgttatcgacagcaccatcggcatgggggaataaccagacgcgagcggcacccaacaccagtactgcaaggatgtaaaccgggatcgtactccagaaaagcgtccatagcgccctgccccagcggctaaaaaacccgccctgtgcttccggtatgtcaatttcgaccggtgcctgcgtttgcggtgtttcacgcacccatttttgcaccagcgtcgcaatcagcaacaccatcaccagcccggccaccagacgaatcgccgcaaaaccccagccgaggacaaagcccataaacaccagcgtcgccgggtttaacaccggattgcccatccagaatgccagcgcaccgcccatcgacacctgttggcgacgcattcccgccgcgaccggagccgcacagcaggtacacatcatgcccggcaacgaaaacagcgttcccagcagcgtgccgcgaaagcgcgattgcccaagcgtacgcaacaaccagtcacgcgggatcagcacctgaatcaacgaaccgaggatcacccccagcaccgccgctttccataccgcgaggaaatagatcatcgcgtaatccaacgccgcctgccatgggttagcatccgcctgcgcaaggatagatttaccgatactgtgggtttcggcagcagtaaacgctttgccgtagtaaggttcccatttcacataccagagaccggcaatgacaacgagaaagaaaagcgcgggtttccaccactgaatgggcgttgccgcctgagatgaagactgaccagtcatagcattccccaggaataagttatgataattgagcgcgtgaatattacgctcactatcaattcttgggaataattattcagctcttttgcgtaattctgaagagcttaaaatcgtcacgccttcatgctcaggccgcatcgactctgccagcatgacccgcgccacgtctctcgcatcaatggatttccagttacctggtaacaaacggaacagcggcgcaaaaagcgtttcgttcatccgctgtttgctacgatcgcccagtaacatcgacgggcgagcaatggtcaatttcggccagttctgggcgattaatgcttcttccatctcccctttgacgcggttatagaaaaacggcgagtgggcattggcacccatcgcactgactaccaacatatgctgcgcgcccagtcgccgcccggttaatgcggtatccactaccagcgtgtaatcggcatgaataaacgcctctttgctccccgcttctcgccgcgtggtgccgagacaacaaaacacaatgtcgatgggatcggtgacctgcgccaacgcgtcactcagttgcggatcatggggattaaacaccccgggcatatcgcccaacggacgtcgcgtcggcgcagcaatggcgttaactttcggttcgttaatcaacatccgcagcaggtgaccgcccaccagccccgttgcgcctgtaatcagtacctgactcatcttcgctcctttacagaattgtctgccttgcgctccacggctcatgcaccaggcttaatagaccatgaggtaattatccccgattgtgggaaattcgcctcatccaatgcaacaacgcggaggaagcatgagtaagaaaattgccgttttaatcactgatgaatttgaggattcagaatttacttcacccgcagacgagttccgtaaagccggacacgaagtgattaccattgaaaaacaagcgggtaaaacggtgaaaggcaaaaaaggagaagccagcgtgaccatcgataaatccatcgatgaagtgacgcctgcggagtttgatgccctgctgctaccgggcggccattcaccggattatctgcgtggggacaaccgttttgtcacctttacccgtgattttgtgaatagtggcaaaccggtgtttgccatctgtcacggcccgcagttgctgatcagcgccgatgtgattcgggggcgcaaactgaccgcagttaaaccgatcattattgatgttaaaaatgcgggcgcggaattttacgatcaggaagtcgtggttgataaagatcagctggttaccagccggacaccggacgatctgccagcgtttaaccgcgaggcgttacgcctgctcggtgcctgagtcgcgtagccaaatcatttttttaccaaagcccagcgtgttgtcggtgaatttgatttcatcgagccggatttcccacaccggggccgacagcattctggcaaccggaaagcgacgattgtacgccttgcgcgcgaggtcgctttcctcaccttccagcctgcggatctcacctttaaactgcacaccgcgaattaacgctaccgttttcggctgaccgtttaccgttccggcaactgccgcctgcggcccgctcatctgcgcgtggcgcgttttttcttccgtcaaaatgtagaaggcgactttctgcgcatcaaaaagataaaaggcattagcgcaccagagttccccttcctgctgcacacaccaggtgacaacatgttgttttgccagccaacggctgatggcgatgagtgtttccattgctgttctcttttatactgtgggcctgaccttaacatgcgatgcagacgatgacaccctggtttctttacttgatccgtaccgccgacaataagctttataccgggatcaccacggatgtcgaacgccgctatcagcagcaccaaagcggcaaaggggcgaaagcactgcgcgggaaaggagaactgacgctggcgttttctgctccagtgggcgatcgttcgctggcgttacgggcggaatatcgcgttaagcaactgaccaaacggcaaaaagagcgtctggtagcggaaggcgcagggtttgcagagctgttaagcagtctgcaaaccccggagattaaaagcgattgaaatgctcgtgatactcaaccaggccggtaacgccattcagcgcgtcatccgctaaacgatgtacctggaaggcgctttcagtgcccggccagcggcaacgcagatcgtgatgcgccgccagttcaaagccgaaacgactgtacagcgccggatcgcccagcgtcaccactgcggcatagccgaactcattaagcgaatcgagtccttcatagaccagttggcgtgccagcccctgtccacggtatttttcatcaaccgccaacggtgccatgccgacccattgcaggtcttcgccctgcacatcaaccggactaaatgccacatagccaatgacctgaccttcgtcatctgtcgccaccagccccagcgtcagaaagccatcttcacgcagatcgtgaaccagcttcgcttccgcatcactttcgaatgagcgacgcagcagggcatcaatacccggcgcatcaatgggaatttctactcgaattagcatggttcacctaccgatgtctgtttggtttcaggcgcggttttcattcccgcctcaacaaaatccgccagttgcagcagcatcatgcgtaaggctttcggcatttgctccagttcaatggcgtccatcaggtttttcacatacagccccagctccgtatcgccttcaatcaccagccgacgctggaagaagagcgtatccggatcctgtttacgcgccgcaatcatcagcagatcgctggcgtcggcactaaaactcacatcagcttgcgcgttctggctgaccaccagtttgccattcaccaccgaggtaaaccattgcaggtcaatatcacgcacatgaatacttaaccagcggccttcaagaaactccagctcgccatcatccagcgcctgacggaattgccagcttaagacctgctcaagaacctggcgttttagcgcaaatggcgtcagttttaccggtacactcaacagagatggccccaaatgcacaatacgggaacgcagtttatccaacacgagttttactccctgtttcaacaatcatcctattttgccatatcagaaaaataacatagcggtataaatcaacaattccatatgaaattgctgctaccaccaatacaactttaactgccttaaatcaaaaattgtcgcagcaaggttaactaaaatcccagttcgttaacatttttgcgttttgatagcgcaaccttcaggaaaaattatggagctgctctgccctgccggaaatctcccggcgcttaaggcggccatcgaaaacggcgcagatgctgtttatatcgggctaaaagatgataccaatgcccgtcacttcgccggccttaactttaccgagaaaaaattgcaggaagcggtgagttttgtccatcaacatcgccgcaaacttcacatcgcgattaacacttttgcgcatccggacggttacgcccgttggcagcgcgccgtggatatggcggcgcagctgggtgccgacgcgctgatcctcgccgacctcgccatgctggagtacgccgccgagcgttacccgcatattgagcgtcatgtgtcagtgcaggcttcggcgaccaatgaagaggcgattaacttttatcatcgccattttgacgttgcccgcgtggtgctgccgcgcgtgttgtcgattcatcaggtgaaacagctggcacgggtcacacctgtaccactggaagtctttgctttcggcagcctgtgcattatgtcggaaggtcgttgctatctgtcgtcgtatctgacgggtgagtcgcccaacaccgtgggcgcgtgttctccggcccgtttcgtgcgctggcagcaaacgccgcaggggctggaatcccgcctgaacgaagtgctgatcgaccgttatcaggacggcgaaaacgcaggttatccgacgctgtgtaaagggcgttatctggtggacggcgagcgctatcacgcgctggaagaaccaaccagtctcaataccctggaactgctgccggagttaatggcggcgaatattgcttcggtgaaaattgaaggccgccagcgtagcccggcgtatgtcagccaggtggcgaaagtctggcgtcaggctatcgaccgttgtaaggccgatccgcaaaacttcataccgcaaagcgcgtggatggagacgctcgggtcgatgtccgaaggcacgcaaaccactcttggcgcatatcaccgtaaatggcagtgagaaaagcaatgaaatattccttagggccggtgctgtggtattggccaaaagagacgctggaagatttttatcagcaggccgccgccagcagcgccgacgtgatttatctcggtgaagcggtctgtagcaaacgccgggcaaccaaagttggcgactggctggagatggcaaaatcgctcgccggaagtggcaagcagattgtcctctccacgctggcgctggtgcaggcatcctcggaactgggcgaactgaaacgctatgttgagaacggtgagtttctgattgaagccagcgatctcggcgtggtgaatatgtgcgctgagcgcaaactgccgttcgtcgccgggcacgcgctgaactgctacaacgcggtgacgctgaaaatattgctcaaacagggcatgatgcgctggtgtatgccggtggagctttcccgcgactggctggtgaatctgcttaatcagtgcgatgagttggggattcgcaaccagtttgaagtggaagtcctgagctacggtcatctgccgctggcctactccgcccgctgctttaccgcgcgttcggaagaccgtccgaaagatgagtgcgaaacctgctgcattaagtatccgaacgggcgcaacgtgctgtcgcaggaaaaccaacaagtgtttgtactcaatggcattcagaccatgagcggctacgtttacaacctcggtaacgagctggcatccatgcagggcctggttgatgtggtccgcctgtcaccgcagggtactgacactttcgcgatgctcgacgccttccgcgctaatgaaaatggcgctgcgccactgccgttgacggcaaacagcgactgtaacggctactggcggcggctggctgggctggaactgcaagcctgaacaaatagctcactttgttaacaactttaactactctttaatgcagtattaaagattaatcggtaacaaagtgagctgttatgactgataaaaccattgcgttttcgctactcgatctggcccctatccccgaaggttcttcagcgcgagaagcgttctcccactctctcgatctcgcccgtctggctgaaaagcgcggctatcatcgctactggctggcggaacaccacaatatgaccggcattgccagtgctgcaacatcggtattaattggttatctggcagcgaataccaccacgctgcatctggggtccggtggcgtgatgttgcctaaccactcaccattggtcattgccgaacagttcggcacgcttaatacactctatccggggagaatcgatttggggctgggccgcgcgccgggtagcgatcagcgaaccatgatggcactgcgtcgtcatatgagtggcgatattgataatttcccccgcgatgtcgcggagctggtggactggtttgacgcccgcgatcccaatccgcatgtgcgcccggtaccaggctatggcgagaaaatccccgtgtggttgctaggctccagcctttacagcgcgcaactggcggcgcagcttggtctgccgtttgcgtttgcctcacacttcgcgccggatatgttgttccaggcgctgcatctttatcgcagcaacttcaaaccgtcggcacgactggaaaaaccatacgcgatggtgtgcatcaatattatcgccgccgacagcaaccgcgacgctgaatttctgtttacctcgatgcagcaagcttttgtgaagctgcgccgcggcgaaaccgggcaactaccgccaccgattcagaatatggatcagttctggtcaccgtctgagcagtatggcgtgcaacaggcgctgagtatgtcgctggtgggcgataaagcgaaagtgcgtcatggcttgcagtcgatcctgcgcgaaaccgacgccgatgagattatggttaacgggcagattttcgatcaccaggcgcgcctgcattcgtttgaactggcgatggacgtgaaggaagagttgttgggatagtgtgtcttaacgcgggaagccttatccgagctggcaacgctgtcctacgtagacctgataagcgaagcgcatcaggcattgtgtaggcagcagaaatgtcggataaggcaccgctgattactgatacaccggcagcaaattaaagctcgataagatatggaccagtgcgttgccaacgccaaacaccagaatcagcgtaatcatcggcttgccgccccagacacggaatttcgggctgccaaagcgtttacgcgatgcacgggctaacagcgccggaacaattgccgcccagatggtagccgctaaaccagcataaccaatggcgtacaggaatccgttcgggaacagcagcccccccacaactggcggggcaaaggtcagcaatgccgttttcaagcggcccacagctgagtcatcgaaaccaaacagatctgccagatagtcaaacaaacccagcgttacgccaaggaacgaactcgctaccgcaaagtttgagaacacgaccagcagaaggtccaggctacggctgttcagcacgccacttaatgcctgtaccagcacatcaatgttaccgcccttctcggcgatgccaataaactccggacgaggaatgttgcccatcgtcgccagcaaccagatggtatacagcgccagtgccatcagcgtaccgtacaccaggcatttcacgatggttttcggatctttgccgtaatacttcatcaggcttggcacgttaccgtgataaccaaacgacgccaggcagaacggcaatgtcatcagcagatacggcgcataagatgcattgctttctgcaacgttgaacaatgtcgcaggctgcacatgccccaacaggctgccaaaggtgaggaagaaggtaatgactttcgcccccagcacaatcgccgtcatgcggctgacggccttagtactcaaccacaccacaaacgctaccagcagtgcaaaaccaaaacccgccgcccgtgccgggacgtttagcgacatctctgcgaaggtgtgatgcagaattgaaccactggcagaaatataggcataggtcaggatatagagcacaaaggcaatggaaataccgttgaccacattccagcctttgcccagcaaatctttggtgatggtgtcaaaactcgaaccgattcggtaattcaggttagcttccagaatcatcaagccggaatgcagcatacagaaccaggtaaagatcagcgccgccattgaccagaaaaaccacgccccggacatgaccactggcagagaaaacatccctgcgccaataatggtgccgccgataatcaccacgccgccaagcagcgacggtgacgtttgggtggtggttagtgttgccatgagggcttctctccagtgaaaaatagtgcgactacgttgttatgtattgcactgtaccagtacacgagtacaaaagacagaaaaaaagccccgatggttaaaatcggggctgtatatattattttacagattgttttcgctgttcagcgatgattacgcatcgccaccgaaacgacgacgaccggtagagtcatcacgacgcggtgcgcggccttcacgacgttcgccgctaaaacgacgaccatcaccacgaccaccttcacggcgttcaccgctgaagttacgaccgccttcacgacgttcgccaccgaaaccacgaccaccgccacgacgctcaccgccagtatgcggctgtgcatcgcccagtaactgcatgttcatcggcttgttgagaatgcgagtgcgcgtaaagtgttgcagcacttcacccggcatacctttcggcagttcgatggtggagtgagaagcaaacagcttgatgttaccaatgtaacggctgctgatgtcgccttcgttagcaatcgcaccaacgatatgacgaacttcaacaccatcatcgcggcccacttcaatgcggtacagctgcatatcgccaacatcacgacgttcacgacgcggacgatcttcacggtcaccacgcgggccacggtcgttacgatcgcgcggaccacggtcatcacggtcacggaattcacgtttcggacgcatcggcgcatctggcggtacgatcagagtacgttcaccctgtgccattttcagcagtgcggcggccagagtttcgaggtccagctcttcaccttctgcagtcggctgaattttgctcagcagtgcgcggtattgatccagatcgctgctttccagctgctgctgtactttagcggcgaatttttccagacggcgtttgcccagcagttctgcgttcggcagttctacttccggaatagtcagcttcatagtacgttcaatgttgcgcagcagacgacgctcgcggttctcaacgaacaacagcgcgcggccagcacgacccgcacgaccggtacgaccgatacggtgaacgtaagactcagaatccatagggatatcgtagttaaccaccaggctgatacgctcaacgtccaggccacgggccgcaacgtcggtcgcaatcaggatgtccagacgaccgtctttaaggcgttccagtgtctgctcacgcagcgcctggttcatgtcaccgttcagcgcggcgctattgtagccgttacgctcaagagcttcagccacttccagagtcgcgtttttggtacgaacgaagataatcgccgcatcaaaatcttccgcttccaggaaacgtaccagtgcttcgtttttacgcataccccacacagtccagtagctctggctgatgtcaggacgggtagtcacgctggactgaatacgcacttcctgcggctctttcataaagcggcgggtaatgcgacgaatcgcttccggcatggttgcagagaacagagcggtctgatgaccttccgggatctgcgccataatggtttcaacgtcttcgatgaagcccatgcgcagcatttcgtcagcttcatccagaaccagaccgctcagtttagagaggtccagagtgccacgtttcaggtggtccagcagacggcccggagtaccgacaacgatctgcggcccctgacgcagggcgcgtaattgcacgtcataacgctggccgccgtacagggcaaccacatttacgccgcgcatgtgtttagagaaatccgtcattgcttcagcaacctgtaccgccagttcgcgggtcggtgccagcaccagaatctgtggtgctttcagctcaggatcaagattctgcagcagaggtaaagagaatgctgcagtttttccgctccccgtctgggccatacccagaacgtcgcggccattcagcagatgtggaatacactctgcctgaattggagatggtttttcgtaacccagatcgttaagggcttcaaggataggagccttcaggcccagatctgcaaaagtggtttcgaattcagccatgtagtacgtgtgcctcaaaattaatggcggccagtctacataactcatcatgaaattgatcagcaattttcattgaaaagtgtgaaccggctcaaagtaggtgtattaacgaacaacaacgccctcacccgttaaggtgatggcaatcaaaaaagattacgggctgatgtgtacgtcagctattgctggtccgattctgccaggtcatcttggtcctggcccaggagcgataattccaacaatgcgtatcggtgctcaacaaagttatgaacgttgttggcaaccgccagtttgaacagtgccgtggcgctgtccaaatcccccagacttaggtagtacttacctaaatagaagttggtttcactgagatgctcagcgagcgaggtgttatccgttgcgtccgccttgagcctttccattaacgtttgttcgctaatgttgcccaggtagaactcgacaatgttccatccccactgttccttatccgatttttcgaagtgctgtttcaacacttctttagcctgcttctcatcgagcttctgctcggcgagataaagccacagactacggaaaggatcattgggatcgtcttgataaaacgccagcagatcatcttgcgctaacttgtcacgaccgccgtaatataatgcgatcccgcgattcaagtgcgcgtagttgtaagttggatcaagctcaagtacagaatcaaacgcttcataggcagcatcaaaattgcctgcctgcgttaaatatatgcctaagtaattgaatacttcaggcatatccggtcggattgccagcgcttgcgaaaaatcgttacgcgctaatgccctcagaccgagactatcatacaacactccgcgctcatataaaagctgtgcgcgttcgtcatcggttaaagcccgactggcaaggatttgttccatacgtgccagaatcacttcctgctgtaaagtcggttgcaatggtaccgcgaggacttcacttttacgccaggaagtattactgcatcctgcaagcgtaagtgctgtcgcaacgaaacaccagcgcaaaaaaggcttcatttcccactcccgaagaccacggttgaatgaacgtcctgttcccggttgctaacaaggcgtcctgcccggttaaaagccccccgccgcagcggagggcaaatggcaaccttactcgccctgttcagcagccggagcttccggtgctgcagcaggttgagactgctcagtcgcttctttaatgctcagacggatacggccctggcgatcaacttccagaactttcaccggtacttcctgacccatctgcaggtaatcggtcactttctcaacgcgtttgtcagcgatttgagagatgtgtaccagaccttctttaccgccgccgatggcaacaaatgcgccaaagtcaacgatacgggtcactttaccagtgtagacgcggcccacttcgatttctgcagtgatctcttcgatacgacgaatagcatgtttcgctttctcgccgtcggtcgctgcaatcttcacagtaccgtcatcttcgatttcgatggtggtgccagtttcttcggtcagagcacggattacagaaccgcctttaccgataacatctttgatcttgtccgggttgatcttgatggtatggatacgcggtgcgaactcagagatatcgccacgcggcgcgttgatcgcctgttccattacgcccaggatatgcagacgcgcacctttagcctggttcagcgcaacctgcatgatctctttggtgataccttcaattttgatatccatctgcagtgcagagataccgtcgcgggaacctgcaactttgaagtccatatcgcccaggtgatcttcgtcgcccaaaatgtcagacagtacaacgtagttgtcgccttctttcaccagacccattgcgatacccgcaacggcagctttgatcggcacacctgcgtccatcagcgccagagacgcgccgcacacggaagccatagaagaggaaccgttggattcagtgatttcagacacaacacgtacggtgtacgggaatttgtccatatccggcatgactgccagcacgccgcgcttcgccagacgaccgtgaccaatttcacgacgcttcggagaaccgaccatgccggtttcgcctacggagtacggagggaagttgtagtggaacaggaaggtatcggtacgttcgcccatcagttcatcaagaacctgcgcgtcacgagcagtacccagcgttgcggtaaccagcgcctgcgtttcaccacgggtgaacagcgcagaaccgtgagtacgcggcagcacgccagtacgcacatccagaccacggatcatatctttttcacgaccgtcgatacgcggttcgcctgccagtacgcggctacgaacaacgtttttctcgatcgcgtgcagaatttcacccagttcgttttcgtccagggtttcgtcttcagcaagcagcgtcgcgatggtttcagatttgatgacatcaacctgcgcataacgctcttgtttgtcggtgatgcggtaagcatcgctcaggcgagcttcagccagtgcagcaacgcgcgcgtttagcgcttcgtttaccggctccggctgccagtcccaacgcggtttaccggcttctttcaccagttcattgatgttctgaataacaacctgctgttgttcatgaccgaacactactgcgcccagcatctggtcttcgctcagcagttgagcttcagattcaaccatcagtacagcggcttcagtaccggcaacaaccagatccagtttgctctctttcagctcgtcctgagtcgggttcagtacgtactggtcattgatgtaacctacgcgggcagcaccaatcgggccattgaacggaataccagacagagacagcgctgcggaagcaccaatcatcgcgacgatatccgggttaacttgcgggttaacagaaaccacggtggcgataacctgaacttcgttgacgaagccttccgggaacagcgggcgaatcgggcggtcaatcagacgcgcgatcagggtttcgccttcgcttgggcggccttcacgacggaagaagctacccgggatacgaccagcagcgtaggtacgctcctgatagttaacggtcagtgggaagaagtcctgacctggtttggcttttttctggccaacaacggtaacgaataccgcggtgtcatccatgctaaccataacagcggcagtagcctgacgagccatcatgccggtttccagagtcacggtgtgttggccgtactggaatttacgaacgatcggattaagcaatgtaatatcctttctctttcttagacagtaccttacggcactggtgttaatacccgatcttctgcgcatcctcgcgactaatgacaaccctaacccagctctatgtgggtaaagcctctcattagccgcgcgaacctctgcaacggaagatcattcatagcaacaatacattagtttccagtgaattgctgccgtcagcttgaaaaaaggggccactcaggcccccttttctgaaactcgcaagaattagcgacgcagacccaggcgctcgatgagctgggtgtaacgtgctacgtctttacgtttcaggtagtcgagcagtttacgacgctgagaaaccatgcgcagcagaccacgacggctgtggtgatcttttttgtgctctgcaaagtggccctgcaggtggttgatctgtgcagtcagcagtgctacctgaacttcggtagaaccggtgtcgtttgcgtcacgaccaaactcagaaacgattttagctgttgcttcagtacttagagacattttaaaactccaaagtatatagaatgaaaggacgccgatctctaattcagcgatcccagtgtacgttacgcaaagtgttaaacaatttacgcgacgttaagcggcagtattctactcgtagcgacctgttatcgcaagacggttaacattacgccgggtattcaaccaccaggcgacgaggcgcaacgcggccttcatcgtcaatttcgcccataccgataaatttgccgttctcaccttccgtgacgcgaaccagtccttccagtggcgcaccagatgtacgaaccgggttaccatttttgaagtaaacagaagacgttaacggaagattcaccaccggatagtccgaagctggactgtccattggcatcagtaatggatcaagtaactccgcggctggaatatcctgctgttcagcttgctcaacaagttcacgcaggtgctccagggtcaccatccgttcaaccggatatttacttaccgccagacggcgcaggtaaataacatgcgcgccacagccgagtttttcacccaggtcatcaatgatggtgcggatataagtgccttttgagcagtgaatttccagctccagctcattgccttcatggcgaataaacagcaattcataaacggtaatcggacgcgcttcacgcggaacttcaatgccctgacgcgcatattcgtacagttttttgccctgatatttcagtgctgaatacatcgaagggatctgttcgatatcgccacggaaagtatccagtgccgctgccagctgctctgcgctaaaggttaccggacgttcttcaacgatctgtccgtcggcatcagaagtatcggtacgctgtccaagacgcgcaatgacccgatagcgtttgtcggagtccagcagatactgggaaaacttcgtcgcttccccgaggcaaatcggcaacatgccggtcgccagcgggtccagcgcaccggtatgcccggcacggttggcgttatatatacgtttcactttttgcagcgcatcgttgctggacataccctgaggtttatccagcaacaaaacgccgttaatgtcgcgaccgcgacgacgaggacgactcattagtcctccttgctgtcgtccgggttaacacgacgttcttcgtcatgtttgaccacgctggtcaccaggtttgacatgcgcatcccttcaaccagagagttgtcgtagaagaaggtcagttccggcacgatacgcaggcgcatcgctttccccagcaggctgcggatgaaaccagaagcttcttgcaacgctttgatgcccgctttaaccgcgtcttcatctttgtcgttgaggaacgtcacatatactttggcatacgccaggtcgcgagacatttcgacaccggaaacggtggtcatcatgcccaggcgaggatctttaatttcacgctgcaggatgagagcgatctctttttgcatttcctgcgctacgcgctgcgggcgaccaaattctttcgccataataaattctcctgacaaaaaaggggctgttagcccctttttaaaattaatttcaggtggaagggctgttcacgttgacctgataagacgcgccagcgtcacatcaggcaatccatgccggatgcagcgtaaacgccttatcccgcatggaaccctaaaaaccttaagcaatggtacgttggatctcgatgatttcgaatacttcgatcacatcgccagtgcggacgtcgttgtagttcttaacgccgataccacattccataccgttacggacttcgttaacgtcatctttgaagcggcgcagggactccagctcgccttcgtagataaccacgttgtcacgcagaacgcggatcgggttgtgacgtttaaccacaccttcggtaaccatacagcctgcgatggcaccaaatttcggcgatttgaacacgtcacgaacttccgccagaccgataatctgctgtttcagttccggagacagcataccgctcatcgccgctttcacttcgtcaatcaggttatagatgacggagtagtaacgcagatccaggctttccgcttcaatcactttacgtgcagaggcatcagcacgtacgttaaagccaaccaggatggcgttggacgccgcagccagggtggcgtcggtttcggtgataccacctacgccagaaccgatgatcttcactttaacttcgtcagtagacagtttcagcaaggagtcggagatcgcttcgacagaaccctgtacgtctgccttcaggacgatattcacttcgtgaacttcgccttcggtcatgttggcgaacatgttctcgagtttagatttctgctgacgcgccagtttaacttcgcggaatttaccctgacgatagagtgcaacttcacgcgctttcttctcgtcacgtacaacggtaacttcatcacccgcagccggtacgccggacaggccgaggatttccaccggaatggacggacccgcttccagcacttcctgacccagttcgttacgcatcgcacgaacacgaccgtattcgaagccacacagaacgatatcgcccttgtgcagagtaccttcacgtaccagaacggtagcaaccggaccacgacctttatcgaggaaggattcgataaccgcaccgctcgccatacctttacgtaccgctttcagctccagaacttccgcctgcagcaggatagcgtccagcagttcatcgataccggtacccgctttcgcagatacgtgtacgaactggctttcaccgccccactcttccggcaggatgccgtactgggagagttcgttcttaacgcgatccggatcagcttctggtttatcgatcttgttcactgcaaccaccaccggtacctgcgccgctttcgcgtgctggattgcttcgatggtctgcggcatcacaccgtcgtcggcagcaacaaccaggactacgatgtccgttgcctgcgcaccacgagcacgcattgaagtaaacgcggcgtgccccggggtgtccaggaaggtgatcatgccgttttcagtttcaacgtggtatgcaccaatgtgctgggtaatgccgcccgcttcgccagaggccactttcgttgaacgaatgtagtccagcagagaggttttaccgtggtcaacgtgacccatgatggtcacaaccggcgcgcgcggttcagccgcagcacccgtgtcacggtcgctcattaccgcctcttccagctcgttttcacgacgcaggataactttatggcccatctcttcagcaaccagctgtgcggtttcctgatcgataacctggttgatggttgccattgcgcccagtttcatcatcgctttgatgacctgagagcctttaaccgccatcttgttcgccagttcgccaacggtgatagtttcgccgatcacaacgtcacggttaacggcctgagcaggcttctggaagccttgctgcagcgaagaacctttacgttttccgcctttaccgccacgtactgctgcgcgtgcttcttcacgatcagcttttgattcagcgtgtttgttgcctttcttcggacgcgctgctttcgcgttacgaccacggccacggccgccttcgacttcacgatcgctttcgtcttctgcctggcgagcatgttgagaagtagtgacgtgataatcgctggaatcttcagtcggttccgcgttatcagtccatttgttttcttccgccatacgacgtgcttcttcagcaacgcgacgtgcttcttcttcgagtttacgacgcgcttcttcttcagctttacgcttgagctctgcagcttcctgctcacggcgggctttttcagcctgggcgtttttagtcatatcgtcttgttgattgctcactttgtctttttccgcagcttcacgtttcgcttgttcagcagcttcacgcttagcttgttctgcggcctcacgttcagctttttgttgcgcctcgcgtttagccgattcttctgcctcacgacgggcttgctcttccgcttcacgctgcgcttgctcttccgctgcaaggcgttcagcctcttgcggatcgcgtttcacaaaggtgcgtttcttgcggacttcgatttgtaccgatttgctttttccaccggtaccaggaatgttaagggtgctgcgtgttttacgttgcagcgtcaatttgtccgggcctgaatttttctgattcaggtggtcaatcaaagtctgtttctcttgtgcagacacagagtcgtcagcagacttccggatacctgcatcagcaaattgctgtaccaggcgttccacggaggtctgtcgctctgcggccagcgttttaatcgttacatctgtcatgctgttccttcctgctacagtttattacgcttcgtcaccgaaccagcaaatattacgggcagccataatcagtgctccggctttttcgtcggtcaacccttcgatatcagccagatcatcaatgccctgttcggcgagatcttccagcgtacaaacgccacgggcggccagtttgaatgccaaatcacgatctaccccttcaaggttcagcagatcgtcagccggtttgttatcaccgaggctttcttcctgggcctgtgcaatggtggccagtgcatttttagcacgctcgcgcagtgcttcaacggtcggctcatcaaggccttcgatttccaacagctctttcatcggcacataggccagttcttccagcgtcgagaagccttcttctaccagaacagtcgcgaagtcttcgtcgatgtcgagatatttggtgaaggtgtcgatcgctgcgtgcgcttccgcctgatgcttagcctgcaggtcgtcaacggtcatcacgttgagttcccaaccgctcagctgcgaagccagacgcacgttctgaccgttacggccaatcgcctgcgccaggttaccggcttcaacggcgatatccatggtgtgtttatcttcatccaccacgatagaagcaacgtctgccggtgccattgcgttaatcacgaactgcgccgggttatcatcccacaggacgatatcgatacgctcgccacccagttcagtagacaccgcctgaacacgcgcgccacgcatacctacgcaagcacctaccggatcgatacgtttatcgttggttttcaccgcgattttcgcacgagaacccggatcgcgagccgctgctttaatttcaatcacttcttcgccgatttctggcacttcaatacggaacagttcgatcagcatttccggcttggaacgagtgacgaacagttgcgcgccacgcgcttccgggcgaacggaataaagcacgccacgaacgcggtcgccagggcggaagttttcacgcggcagcatatcttcacgcaggatcacggcttcagcgttgttgcccagatccagagagatgttgtcgcggtttacttttttcaccacgccggtgatgatttcaccttcgtgttcacggaactgatcaaccaccatcgcacgttcggcttcacgcactttctgcacgataacctgttttgccgtctgggtagtgatacggtcaaaggtaacagactcaatctgatcttcaacgtaatcgcccaggttcaggctttcatcttcataacgtgcggcttcaagggtgatttccttggtcggctgggtgacttcatcaacaactaaccagcgacggaaggtgtcaaaatcaccgcttttgcgatcgatctgtacgcggacgtcgatctcttgttcatattttttctttgttgctgtcgccagcgcgctttccaatgcttcgaaaatcttctcgcgaggtagcgccttttcattggatacggcttcaactacagccaaaatttctttgttcatcgcgggcttttcacctcatccagactattaaaagtggggaaccaggttcgccttctggatattactcagcgcgaacacttcatctttaccttcgacggtaactgtgatcatttcaccgtctaccgctttgataacgccctgccatttacgacggttttgtaccgccatacggagaaccagagtcacctcttctccgacaaaacgggcgtagtgttcagccgtgaacagtgggcgatcgagacccggtgaggagacttccaggttataagcaacggtgatgggatcttcaacatccagcacagcacttacctggtggctcacatcagcacaatcatcaacattgatgccatcttcactatcaatatagatgcgcagtgtggatgtgcgaccgcgaataaattcgatgccaaccagttcaaaacccagggcctcaactggcgcagtaatcatctctgttaatttttgctctaatgtggacaagcccacccccaagacataaaaaaagggcctaaagcccagttattctgtagtcagataacaaaaaaccccgataaatcggggctttatataactgaaccctataaccgcaactgcggtctggagcactttccagaaggattttttcaaatcccactacgaaggccgaagtcttcacagtatatttgaaaaagaactctaagggaaagtggttgcgggggccggatttgaaccgacgaccttcgggttatgagcccgacgagctaccaggctgctccaccccgcgcctgaaacgtggcaaattctactcgttttgggtaaaaaatgcaaatactgctgggatttggtgtaccgagacgggacgtaaaatctgcaggcattatagtgatccacgccacattttgtcaacgtttattgctaatcatgtgaatgaatatccagttcactttcatttgttgaatacttttgccttctcctgctctcccttaagcgcattattttacaaaaaacacactaaactcttcctgtctccgataaaagatgattaaatgaaaactcatttattttgcataaaaattcagtgagagcggaaatccaggctcatcatcagttaattaagcagggtgttattttatgacgacgattctcaagcatctcccggtaggtcaacgtattggtatcgctttttctggcggtctggacaccagtgccgcactgctgtggatgcgacaaaagggagcggttccttatgcatatactgcaaacctgggccagccagacgaagaggattatgatgcgatccctcgtcgtgccatggaatacggcgcggagaacgcacgtctgatcgactgccgcaaacaactggtggccgaaggtattgccgctattcagtgtggcgcatttcataacaccaccggcggcctgacctatttcaacacgacgccgctgggccgcgccgtgactggtaccatgctggttgctgcgatgaaagaagatggcgtgaatatctggggtgacggtagcacctataaaggaaacgatatcgaacgtttctatcgttatggtctgctgaccaatgctgaactgcagatttacaaaccgtggcttgatactgactttattgatgaactgggcggccgtcatgagatgtctgaatttatgattgcctgcggtttcgactacaaaatgtctgtcgaaaaagcctactccacagactccaacatgcttggtgcaacgcatgaagcgaaggatctggaatacctccactccagcgtcaaaatcgtcaacccgattatgggcgtgaaattctgggatgagagcgtgaagatcccggcagaagaagtcacagtacgctttgagcaaggtcatccggtggcgctgaacggtaaaacctttagcgacgacgtagaaatgatgctggaagctaaccgcatcggcggtcgtcacggcctgggcatgagcgaccagattgaaaaccgtatcatagaagcgaaaagccgtggtatttacgaagctccggggatggcactgctgcacattgcgtatgaacgcctgttgaccggtattcacaacgaagacaccattgagcagtatcacgcgcatggtcgtcagttgggccgtctgctgtaccaggggcgttggtttgactcccaggcgctgatgctgcgtgactctctgcaacgctgggttgccagccagatcactggtgaagttaccctggagctgcgccgtgggaacgattattcaatcctgaataccgtctcagagaacctgacctacaagccagagcgtctgacgatggaaaaaggcgactcggtgttctcgccagatgatcgtattggtcaattgaccatgcgtaacctggatatcactgatacccgcgagaaacttttcggttatgccaaaactggcctgctttcctcctctgccgcttcaggcgtgccgcaggtggagaatctggaaaacaaaggccagtaattcgacatcaaccctgcccttcaggggtggggttaccttgcttatcctctgtaaactcctttctgagcatcacataatcgaaaacatcatggtttgcatccacaacccgtgagtctcctttatagtgtgcaatcacttcctcaagcgtttgcggctgttccggctttgttacccccatccacgcattaataaggtaattattgtaagctgtcgaaaagatgttgttttccgttgtgcgatccacgccatccccaagaacggggctataccagataaacatcgggacatgatatgcctgctggctagcctccctgcctccatgaaaatagacgttcttcttcgtagggtcacgttccaggccgtggtcggcaaaatacatgaccgaggcgcggcgatcttttaataattcaaaaacctgacctagcaaactatctgtgtaatgaatggagttgtcatagcaggcatcctgatcgtcctgcggttgaaacacggcgctggattgcggataggcgctacaagccggttcatggcttccatttaaatgaagaacaatcagtttcttttgctgcgtattttgctgtaatgcttgcgataaatgcggcaacaacaattcatcaaatcctctgacataaactgtttccatggcgcgcatggcgatactggtaactgctgtaccattctgccgaaaagcggattgcgagcttagccagaaagtctgaaatcctgcttgattagccatattaataatgttgtcggggtaattatgaatgtcatgactcaaaacagaatcagcagttaaagaaaggggaaccgacagcgcagtgtaaggtgcgccgcttattgcttgattaaacagtttgatctgttttctttgtgcttcaacttgcggtgtcgtagagcgtgtatatccatacaaagacatattgtcgacacgtacagactcccccacaatcaacacgtaggtatcaatacctgtatccctgactgataattgaaaatacggcaccgtgtttgcaattgagagtaatctttgatgctctttcgctgctaaagcaaaatagttgagattgaaaaacggcgtataggtagcaaatcgcgacgctagtatatatggactgaacgcttttttattttttgcatctttataagcaaattgacaagcggaaaataaactgcccgaaatgacaatcagcaataatattcctgtcactttttttgtcggcaaggaaacatcatattttattattactgccaaaaaaagaagggataaaaaagcaaaggcacatagataagggatatacatccccagcattttgacaacttcatccggatcactctggagcacactaatcgcaaatccatcattgaaagttgtaccaaaggtacaccatgaatagaggctaatactcatgtctgccgcagtcagtaacacaaatggtgcggcaacaagcaggcgaagcggaagggatgatatacgttttacaaccaggatggtcagaacgaagaacagcaagcgctgaaccatatgcgcgccggaagaggcgactaagttcgtaataccaaaaacaataacacaaagatacaacaaccaatgagatttaaaacttctagcaaatttgttgaatactgtcatccagaaatccaagttcacaaccaatataaacaattatcaacaatgttcaattttatatcagacatgtttttcaactctgatccatatcagaccgaaacactgttagttttttctttttaaatgatgcggccattgcgttctcagtaattaaataacattatcaatgcgtctctaaacattacgcagaacgtagccatcagtagttatactgacaggagcaggatggtttatcgagaagtaaacatatccgtattcgtaccggaactggagttgacacaataaagtgccaattatgtcagcagaagggaaaagtttataactaaggcgtaccggcaccatcgtttcaaggtaccagctacgagtaaagcaactggacgagatacagatacctgacaaccattcctcagaccaggaccaaaacgaaaaaagacgcttttcagcgtctcttttctggaatttggtaccgaggacgggacttgaacccgtaagccctattgggcactaccacctcaaggtagcgtgtctaccaattccaccacctcggcacggatactactttttagttcgggatatcgctggtcggcttagccggagcagctggttgagtttgttcggttttcaccggtgcactcagattttcccattcgctacctttattggttttgttgctattgatgttacccagcaccagactgatgatgaagaataacgttgccagcagcgccgtcatgcgggtcatgaagttaccagaaccacttgaaccaaacagcgtagcggaagcgcctgctccgaaggaggctcccatatcagcgcctttaccttgctgcagcatgatcagaccaacaaggccaattgccacaataaggaaaactactaaaagagcttcgtacataatcaacctgttccttgcggagttgccgcgtaccaatgcttcaaccaataaagcgggagtttttaatctttcccactgaagcgggtgtgaatactaaccaaagcgaatgaccttcgcaagggcaattttatcgcattgtatcaactgcggaaaaaaacagcaaaaccgatgtgttcgctgagaaaaaaggcgacaatcgccgcctttttagccagttatctaacgctttaaacggcttttactgcatcggcgatgcggtgtgcaaattcagtcacctgcgcttcgtcttcgccttccaccatcacgcgaattaacggttcggtgccggatttacgcagcaacacgcgtccacggttgcccagcgcagcttcaacctctgcggtcacggctttaactgactcatgctcaagtggatcgccgctacctgcggtgtaacgtacgttaaccagaatctgcgggaacattttcatgccgctgcaaaggtcgtgcaggctcatatggttacgtgccatagccgccagcacctgcaagccagcaacgatgccgtcaccggtagtagttttatccagcaggatcacatgaccggaattctctgcaccgatacgccagcctttctcctgcattttttccagtacgtagcggtcacccactttcgcgcgcgcaaatggaattcctaactgtttcagcgccagttcaagccccatgttgctcatcaatgtacccacagcgccaccacgcagctggccctgacgaagaccttcacgcgcgatgatatacatgatctgatcgccatcgactttattgccttcatggtcaaccataatcacgcgatcgccatcgccgtcgaaggcaataccgagatccgctttttcagccagcacacgagcctggagcgcgcgaacgtcggtagcccccacttcggcattgatgtttacaccgtttggctcacaaccgatagcgataacgttcgcccccagttcgcgcagcacgttcggcgcgatgtgataagtcgcaccgtttgcacaatccaccacaatcttcagttcactgaggctaagttcgttcgggaacgtggctttgcaaaactcgatatagcgacccgcggcatcaacgatacggctggctttacccagttctgccgaatcaacgcagctgatctccttttccatttccgcttcgatggcctcttctaccgcatccggcagtttggtgccgtcgatagagaagaatttaatgccattatcgtagaacgggttatgcgatgcagatatcacaattccggcctctgcgcggaaggtacgcgtcagataagccacggccggtgttggcatcgggccagtgaagagtgcggaaaggcccgctgccgccagacccgcttccagtgctgactccagcatatagccagaaatacgcgtgtctttaccaataatgatcttacgggagccgtggcgcgccagcactttacccgcggcccaacccagcttaagcacaaaatcaggtgtgatcggcgcatcccctacacgaccacgaatcccatcggtaccgaaatatttacgattactcatagcgtttgttttcctttgcagacagagtggcttccaccacccgcatcgcttctacggtttctttgacgtcatgaacacgaataatgtgcgcgccttgcattgcggcaatgaccgcacaggccagactaccgctcaggcgctcggacggccccacgttcagcagctgcccaatcatcgattttcgtgacatacctaccaacagcggcaggttgaaatggtgaaattcagccaggcgcgccagtaatgaatagttatgggagagatttttaccgaaaccgaatccggggtcgagcaacaatttctcttttgcgatacccgcctgctcgcaacgtgctatttgctcaataaagtagcgattcacttctgcaaagacatcgtcatacttcggagcttcctgcatggtttttggatttccctgcatatgcatcagacaaaccggtaaaccggtttctgcagccgcctccagagcgccaggttcggaaagggagcggatatcattaataatgtgagcgccaactttcgctgactcacggatgacttctggtttggatgtatctaccgagatccagacttcgaagcgttgagcaattgcctcaaccacaggaataacacgttgcaactcttcttcaacgctaacttccgccgcccctgggcgcgtggactcgccaccaacgtcaatgatcgtcgcgccagcgttgatcatcagattcgcatgtttcaccgcatctatcagcgagttatgcgtgccaccatccgaaaaggaatcaggcgtgacgttgaggatccccattacgtgaggatggctaaggtccagtgaagtaccctgggcaaagagtttcatgatgttatccctagtatgaattgataagaaaaaaccccggagcacgccccggggttttcggtacaaatacagtcatctgatgcgggaacttacttgtcgcctaactgctctgacatggtgttacccgggttcggcgtacgcggttcatcaaccggacgaggagcctttggactaccattgtcgccagaattgttagaagcgcctggttcttcccagcccgctggcggacgtacatcgcgacgtgccatcaggtcatcaatctgcggtgcgtcgatagtctcatatttcatgagagcatctttcatcgcatgcagaatatccatattgtcggtcagaagctgacgcgcacgattatagttacgctcaatcagtgctttcacttcctggtcgatgatacgtgcagtttcatcggacatatgtttcgctttcgctacgctacggccgaggaacacttcaccttcttcttccgcgtacagcagtgggcccaatttctcagagaagccccactgagtcaccatgttacgtgccaggttggtcgcaactttaatatcgttggacgcaccggtagatacatgttccggcccgtagatgatctcttctgccagacgaccaccgtacagcgtagaaatctggctttccagtttctgacggctggcgctgattgcgtcgccctcaggcaagaagaaagtcacacccagcgcacgaccgcgtgggataatcgtcactttgtgcaccggatcgtgttccggcaccaggcgaccgataatcgcatgacccgcttcgtggtaagccgtcgattctttctgcgcttccgtcatcaccatggagcgacgttccgcacccatcatgattttgtctttcgctttctcgaactcaaccatcgacacaacgcgtttgttgccacgagcagcgaacagtgccgcttcgttcaccaggttcgccaggtcagcaccggagaaaccaggagtaccacgggcaatgattgccgcgtcgatatcgggtgccaatggtacgcgacgcatgtgaactttcaggatctgctcacgaccgcgaacatctggcaagccgaccacaacctgacggtcgaaacggccaggacgcagcagggccgggtcgagaacgtccggacggttagtcgcggcgataacgatgataccttcgttaccttcgaagccatccatctcaaccagcatctggttcagagtctgttcacgttcatcgtgaccaccgcccagaccagcgccacgctggcggcctacggcgtcgatttcatcgataaagatgatgcacggtgccgctttcttcgcctgttcgaacatgtcacgaacacgggatgcacccacaccgacgaacatttctacgaagtcagaaccggagatagtaaagaacggaactttcgcttcgcctgcaatcgctttcgccagcagcgttttaccggtacccggaggaccgaccatcaagacgcctttcgggatcttaccgccgagtttctggaagcggctcggctcgcgcagatactcaaccagttcagcaacttcttcttttgcttcgtcgcagcccgcaacgtcagcaaaggtcgttttgatctgatcttccgtcagcatgcgcgctttgctcttaccaaacgacatggcacctttgccaccgccgccctgcatttgacgcatgaagaagatccagacaccaatcagcaacagcatcgggaaccaggagatgaagatagaagccagcaggcttggttcttcaggcggttcaccgacaaccttgacgttcttggtcaacaggttatccagtaatttcggatcctgaaccggaatgtaagtggtataacggttactatctttcttggtaacgttgatttcacgtccgttgatacgcgcttcacgaacctggtcgttattgacctcttgtaggaaggtagagtaatccaccttacggccattagactcgctgggcccaaagctctggaatactgacatcagcacaacggcaatgaccagccagagtattaggtttttcgccatgtcactcaagggattaacctcttattacaactgtgttaaaaacagcgtcaggatactctatatccagcatctttcaaactttcgtctgaaatctcccggttagggtttacgcccggtcgctacaatatacacttcccgcgaacgtgcacgagaagagtccggcttacgaactttgaccttcgtaaacagggagcgaatttcccttagatactcatcgaaaccttcgccctggaacaccttcactacaaaactgccacctggcgctaatacatcacgacacatttctagcgccagttccaccagatacatggcacgggggatatccaccgccggtgttccgctcatgtttggtgccatatcggacatgacaacctggactttgctgtcgccaacgcgctccagcagtgctttcatcaccagttcatcacgaaaatcgccctgaagaaagtccacaccaacgataggatccataggtaaaagatcgcaagcgatgatgcggcctttgccgccaatttgggtgaccacatattgtgaccaaccacccggagcagcaccaaggtcgacaaccgtcattcccggtttaaagagtttgtcactttgctgtatttcatcaagtttaaaccaggcacgggaacgtaacccctttttctgtgcctgttgaacatatttatcgctaaagtgttcctgaagccagcggctggagctggcagaacgcttcttacctgtcatttaactttcccatggggataactcatcgtaaccaattgcgtaaatttttacgcgcctatttggtgatatatgggagatggcggtagaatgacccgttttcaatcccaacgtaagcaaaaaatacgatgaatctgagtactaaacaaaaacagcacctgaaaggtctggcacatccgctcaagccagttgttctgcttggcagtaatggtttgaccgaaggggtgctggccgagattgaacaagcgttagagcaccatgaactcatcaaggtgaaaatcgccaccgaagatcgcgaaactaaaaccttgatcgtggaagctatcgtgcgcgaaaccggcgcctgtaatgtacaggtcatcggtaaaacgctggtgctttatcgcccaactaaagaacgtaaaatctcgctgccacgctaagattatcctaaagttacacacatttgctgtgtaaaacgaggggttttccgcaggcaggagagcaaaatgccacgctctgttcgttgataaaaggccgcatagcggcctttttcctttctttacaatacatcaacatcttgagtattgggtaattcttacaggtattccaccttaattacttcaaattctacttcgccgcccggcgttttgatgaccacaacatcatcttcttctttgccgatcaggccacgagcaataggcgagtttacagaaatcaggttttgtttaaagtcagcttcgtcatcgccaacgatgcgataagtctgttcttcgtcagaatcgagattcagcaccgttacggtagcaccaaaaataacgcgcccattgttgggcattttggtgacatcaatcacctgcgcgtttgacagcttggcttcgatgtctttgatacggccttcgcagaagccctgctgttcacgagctgcgtggtattcggcgttttctttcaggtcgccatgctcacgcgcttccgcgatagcagcaatgatttcaggacggcgcacagatttcagaaaatccagctcttcgcgtaatttttcagcgccgcgtaaggtcatcggaatagcttgcatttgttatacctcttgaatattcctgatggggcaagtcttcacccaccccggctgttcggcctgcccggcataactcctcaccgggaccagaagcaaaaaaataccgacccgggtacaagtcccaggtcagctacaattcacattttgatagtcattttaccctgaagttcccgaagggtcatcgtttactttatagggcgttgcgccgtagtatgacggctcgattccaggttgttagcgcgagattatgcgattttccagatttatcatcggattgaccagctgtatagcgttcagtgttcaggccgcaaatgttgatgagtatattactcaactccccgctggtgccaaccttgccctgatggtgcaaaaagtcggcgcgtcggcccccgctattgattaccacagtcagcagatggcgctgcccgccagtacgcagaaagtgattactgcgctggcggcgttgattcaactcggccccgattttcgttttaccacgacgcttgaaaccaaaggcaatgtggaaaacggcgtacttaagggtgacttagtggcgcgatttggtgccgatccgacgttaaaacgtcaggatattcgcaatatggtcgcgactttgaaaaaatctggcgtcaaccaaatcgatggcaatgtgttgatagatacctccattttcgccagccacgataaagcccccggctggccatggaatgacatgacacaatgctttagcgctccgcctgccgccgccatagttgaccgcaactgtttctccgtctcgctctacagtgcccaaaaacccggtgatatggcctttatacgcgtggcatcttattaccccgttacgatgttcagccaggtacgcaccctcccccgtggttctgccgaagcgcaatactgcgaactggatgtggtgccaggcgacctgaaccgctttacgctgacgggatgcctgccacaacgttctgagccgctcccgttggcttttgccgtacaggatggagccagctatgccggggcaattctgaaagatgagttaaaacaggcgggtatcacctggagtggaacactgctgcgccagactcaggttaacgaacctggaacggtagttgccagtaaacagtcggccccgctgcacgatctgcttaagattatgctgaaaaagtcagacaacatgatcgccgatacggttttccgcatgataggccatgcgcgcttcaatgtgcctggaacatggcgggccgggtcggacgccgtgcgtcagatcctgcgccagcaagccggtgtcgatattggaaacaccattattgccgatggttcagggctttcgcggcataacctgattgcccccgccaccatgatgcaggtgctgcaatacattgcccaacacgacaatgaacttaactttatctccatgctgccgctggcgggctatgacggctctttgcagtaccgtgcaggtctgcatcaggcgggcgtggatggcaaagtctcagcgaaaaccggttcgttgcagggggtatataacctggcgggattcattaccacagcgagcgggcaacgaatggcgtttgtgcaatatctttctggctatgcagtagaaccggcggatcagcgtaatcgccgtattccgttagtgcgtttcgaaagccgtttgtataaagatatttaccagaacaattagtcaaaaagaaaccccggcatatggccggggtttcagattattgacaaagtgcgctttgtttatgccggatgcggcgtgaacgccttatccggcctacaaaatcgtgcaaattcaatatattgcaatcatcttgtaggcctgataagtgtagcgcatcaggcttatttggcattggtcattagtgattaacgcttgtaaatgaactcaacgccttcttcgtcgtcttcgtcccagtcgtcatcccagtcctcatcatcctcttcagcaatctcttcaagctgctggcgatgataatcatcccacatgaattcgactttctctggctgtttcgcttcttcagcctgcacgaccgggttttcaatgataaaggtcatcacatcccagcagagatctttcacgcccagtccgctcgccgcagagatcagataatatttatcttcccagcccagcgcctcagcgatcgctttcgctttctcttcggcttctgccttatccagcagatcgatcttgttgaacactaaccaacgcggtttcgccgccagatcctggctgtatttttccagctcgctgataataatacgcgcgttttcaaccggatcggtgccgtcaatcggatcgatatcgatgaggtgcaacaggacgcggcaacgttccaggtgcttcaggaagcggatacccagacctgcgccttccgcagcgccttcaatcagtcctggaatatcggcaacaacgaagctcttttcgttgtccattcgtaccacacccagacttggcaccagagtggtaaacggataatccgccactttcggtttagccgccgataccgcgcgaataaaggtcgatttccccgcgtttggcatccccaacataccgacgtcagccagcagcatcagctccagcagcagctcacgcttatcacccggcgtaccgttggttttctgccgtggtgtacggttaacggacgatttgaaacgggtattgcccagaccgtgccagccgcccttagcaaccagcagacgctgaccgtgtttagtcatatcgcccatggtttcaccagtaccctggtcgattacacgcgtacctaccggcactttaatcgtcacgtctttaccgcgcttaccggtacaatcgcggcttgcgccgttctgaccgcgctctgcacggaaagatttttcaaaacgataatcgataagcgtgttcaggttttcgtcggcttccatccatacgtcaccaccatcaccaccgtcgccgccatccgggccgcctttcggaatatacttttcgcggcggaagctcacgcaaccattaccgccatcacctgcaacgaccagaatcgatgcttcatcaacaaacttcattttattctccgtaaatcattcgcctgcgcggggttgcgataccaccgttgtatgcttacgtaatccgccccaaatacgatgaccaatggcggaatacatcgcgcccgcaaccacgacaaacgcaccgagataacctaaaaggtttaacatcggtctggcgaagaaatcgggccaggccagtgataaaagatctgaaaaaaacagcgtaaacagtggggtgagcgtgatgatcgcgctcacctgcgctgcctgccagcgagccatcgcttccgccagggcgccatatcctaccaatgtattcagtccgcaaaaaattaaacatgcgagctgccagtggctaagctgcgctatcactccaggctttgccagagggaagagcgcgattgtacataaagtgtacagcaaaaacaggatctgcggtgaggccagccgacgcaataaaaccttttgcgccacgccataactcacccaaaccgtcgccgcaccgaccccaaagatgactccccaggtgtaatcagtgagctttgtaaatatctcgaccagactggtgttaaaaaacatcaccaggccgctcaggagcatcaatgcccctacaacctgagtgctgcgcattttctctttcaggataaatacgctggcaaccatcatgccaactggcgagagttgcccaatcacctgcgaagcggtcggactcaggtattgcaaggatgagctgaacaggatgaagttcccaaacagcccggcggtcgccactgccaacaaaatcaaccagcgtggcttacgaaacacgcgtaatggcggcaacctcttcttcaccgcaagaatggcacccaggccaatactcgccatcaagaaacggtaaaacacgattgtcggaggttccatcacctccagcacctgcttcattgcgattggcaacgccccccagcaaattgctgtggtgagcgccaaaagaatgccaatgcctgcctgctgcttcataccgtattccctgcaaagcgcatttgcggattaacgtcgcaccatgctcatttttaccggttatcgaatgtaaaaagccccgcaacgtgttgcggggctttcatccgttaccgggacgcgaaaaacttattcagcttcgatgctgataaatttacggtttttcgggcctttaacttcgaatttcactttaccgtctgctttagcaaacagagtgtggtcacgaccgcaacctacgttagcgccagcgtggaatttggtaccacgttgacgaacgatgatgctacccgccagaacggattcgccaccgaaacgcttaacgcccaggcgtttagcttctgaatcgcgaccgttacgtgtggagccgccagcctttttatgtgccatttgaaatctctcctcaggtcttaggcgctgatgccagtaattttcacatcagtgaaccactgacgatggccctgctgcttacgatagtgtttacgacgacgaaacttaacgattttaactttctcgccacgaccgtgagcaacaacttcagctttgattacgccgccatcaacgaaaggaacgccgattttgacttcttcaccgtttgcgatcatcagcacttcagcgaactcaacagtttcgccagttgcgatgtccagcttttccaggcgaacggtctgaccttcgcttactcggtgttgtttaccaccactttggaaaaccgcgtacatataaaactccgcttccgcgcacaccttttcaatgattcagagtgcgctataaatattcacaatagggcgcgaatattacgcaaaacgcacgcctttgacaagtgctacagtcaatacacgaagaaaaaaaacacaacttgtacggtaacgtttatctgtgccattttttcagtacaatcaccctatattcctaaccataaaccctaagttgcctttgttcacagtaaggtaatcggggcgaaaagcccggcttttgcgatgaatttagaaaaaatcaatgagttaaccgcgcaagatatggcgggtgttaatgcggcaatccttgagcagcttaattccgacgtccaactgatcaatcagttaggctattacatcgtcagcggcggcggtaaacgtattcgtccgatgattgctgtactggctgcacgagctgttggctatgagggaaatgcgcatgtcaccattgctgccttgatcgagtttatccacacggcgactctgctacacgacgacgttgtggatgaatcagatatgcgcaggggtaaagctaccgccaacgccgcatttggcaatgccgccagcgtgctggtaggcgattttatttatacccgcgctttccagatgatgaccagcctcggttcactcaaagtgctggaagtcatatcagaagccgtaaacgtcatcgcagaaggtgaagttctgcaactgatgaatgttaacgatccggacatcactgaagaaaactacatgcgcgttatctatagcaaaaccgcgcgtctgtttgaggctgccgcgcagtgttccggaattctggctggctgtacgccggaggaggagaaaggcctgcaggattatgggcgctatctcggcactgctttccagttgatcgacgatttactcgattacaatgccgatggcgaacagttaggtaaaaacgtcggcgacgatctgaacgaaggtaaaccgacgctgccgctgctgcatgcgatgcatcatggcacaccagaacaggcacagatgatccgtaccgccatcgaacagggtaacggtcgccatcttctggaaccggttctggaagcaatgaacgcttgtggatctcttgaatggacgcgtcagcgcgccgaggaagaagcagacaaagccatcgcagcgttacaggtgctcccggacaccccttggcgagaagcactcatcggcctcgcgcacatcgctgttcaacgcgatcgttaatcccctcccctcatcccgcgcagtgcgcgggatgattccagtaaactccataagaatacttattcagcgtaataatgcactgaaaaaccagtgtatacatctttatatattctgaatattcacactctttacaggaactttttagagcaatcggccatcaggagtatagtgatgctcgacagaagaagtgttctgaatgaaagcgactaacttaaggagtgaggaaagatggaaagtaatttcattgactggcatcccgctgacatcattgcgggtttgcgcaagaagggaacgtcaatggcggcggaatctcgcagaaatggtttgagttcctcaacgctggcgaatgcattatcgcgcccatggccgaaaggagagatgattattgcgaaggccctgggaactgacccctgggttatctggccatcacgctaccatgatccgcagacccatgagtttatcgacagaacgcagttgatgcgtagctacactaaaccgaaaaaatgagtggtctggcggtagccccgcgtacggggctgccagctttcagacgattactcgcctttcacacgctcaatatttgcacctaaagcgcgcagtttgtcttcaatgcgttcgtagccacgatcgatgtgataaatacgatcaaccaccgtcgtcccttccgcaatacagccagccagcaccaggcttgctgatgcacgcagatcggttgccataacctgtgcgccagaaagtttttcaacaccgtgacaaataacggtattgctttcgatttcggcgtgcgcgcccatacggctcagctctggcacatgcataaagcggttttcaaagaccgtttcggtgatgaatccagtcccttctgccaccaggttcaacagcgtgaactgggcctgcatatcggtcgggaatgccggatgcggcgcggtacgtacgttaacagccttcggacgtttgccatgcatatccaggctaatccagtcttcgccgacttcgatgtccgctccagcgtcacgcagtttcgccagcacggcgtcgagagtatctggctgcgcgttacggcagataattttgccgcgagaaatcgccgccgccaccaggaatgtaccggtttcgatacgatccggcagcacgcgatagacaccgccgcctaaacgttccacaccttcgatgacgatacgatcggtgccctgaccgctaattttcgcacccagcgtaatcaggaagttcgcggtatcgacgatttccggttcacgcgctgcgttttcaataatcgtggtgccttccgccagggttgcagcacacatgatggtcaccgttgcgccaacgctgactttatccatcacgatatgtgcgcctttcagacgaccatcgacggaagctttaacgtaaccttcttccagtttgatggtcgcgcctaattgttcgaggccagaaatgtgtagatcaaccggacgcgcaccgatcgtacaaccgccaggtagtgaaacttgcccctgaccaaagcgcgctaccagcggccccagtgcccagatagaagcacgcatggttttaaccagatcgtaaggtgcgcagaatacattaacgtcgcgggcatcaatatgcacagaaccattacgttctactttcgcacccagctggcttagcagcttcattgatgtatcgacgtctttcagtttcgggacgttctggatctctaccggttcttccgccagtagagcggcaaaaaggataggcagagcagcatttttagcgccggaaattgtgacttcgccctggagcttcgttggcccctgaacacgaaatttatccatttagtttgttctcagttaacaattcatatccgctaccggcgaatcgcccatagctcaaaagccgttcagtttgcgatcgcgcgcccactccgcaggggtatacgctttgatcgacacagcatgaatgcggttatccgcaatatattccatcagcggaccatagaccgtctgctgttttttaacccgactcatgccgtcaaacaactcacccacggcaataacctgaaagtggctgccatcgccggaaacgtggacttcctggagggagagagcgttcatcaacacgctctgaatttcattattttccatgggatcttcaatcatcagttaataaaccagcgaaacatcttagagcaaagttgcgctggcataaataagcaaaaagcctcgctgataaatcagacaaggctcgacttgcaggcaggtttgccggacaggcggttaacgccatatccggcctgaaaaaatttaacgaggcagaacatcagcaggcaaattatacaatttcgccagggtatacactttgtcgtttaccccctgaagcgtcacattgttgccctgctttttcgccagatcgataagatggagcagcagtgccagtccccccgtatccacgcgggagacacggctaagatcgatgcaggtaatccccttcaccgcttcctcacgcatttcccaaagcggtagcaaaacgtcctgatccagctctccggataacgccagcgtgtcacccgtctgcatccagctcagtgactcgctcattattttttctcttccagagtgattttctgttgagaaatcgatttcagttgcgcagtcaggccgtcgatacctttggtacgcagcagcgttccccactcgttttgtttggtggtgatcatactgacgccttcagcaatcatgtcgtaagcctgccaattgcccgtctgggagtttttacgccactggaagtccagacgcaccggcggacggccattcgggtcaataatggtaacgcgaataggcacaatggttttatcgcccagcggctgttctggcgcaatctgataggtttgaccgtgatacatcgccagcgcctgcccgtaagcctgcttcaggtactcacggaaagcggcaaagtaggcttcacgttgagcaggggtcgcactcttgtaatactggcccagcaccagcgcaccggcgtatttcacctgtacgtatggcagcagttcctgatcaacaatggtacgcagataatccgggttggcccgaatttgcggttgctcattcttcaggcgatcgaacgttttctgcgccgcctcgtccatcagcttatacggattggtctggtctgccgcggttgccgcactcagaggtgcaatcaccagcaaagcgaccatcattaaacgtttaaacatgcgtcggttctcctgaaattatttcgttgtacccacaggttcagtggtttcattattacctggcgcagcagctggcgcatcgccactattcttattgtcatcgcctttactaccgtaaaggaactgaccaatgagatcttccagcaccatcgcagacttagtgtcctgaattgtatcgccatccttcaggatagcagtccccagttccgggtcttcaaaaccgacgtttaatgccagatattgttcccccagcaggccggaagtacgaatgctcagcgaactggtatctggaatgtggttataacgttgttcaatttccagcgttacgcgcggcagataggttttcgggtccagcgtaatatccgccacccgacccacaacaacgccaccaatactgaccggagagcgcgctttcaggccgccaatgttatcgaacgtcgcataaagcgtgtaggtcggttcagtacgtatggacgtcacgttcgccgccttcaggcaaacaaacagcgccgccagcagtgctgctaataaaaagatacccacccaaatttcattttttttcgtttgcatgaactcaattcccaaacatcaatgcggtcagcacaaaatccagccccagaacagccagagacgagtggacaacggtgcgagtggttgcccggctaatcccggcagacgtcgggatggcgtcgtagccgttaaacaacgaaatccacgtcaccgtgatggcgaacaccacgctcttaatcagacagttgaccagatccatacgccagtcgacggcattttgcattgccgaccagaagaacccgctatcaatgcctttccaactgacgccgaccagagatccgccccagatccccacggcgacgaaaataaccgtcaacagtggtaatgaaataaccccagcccagaaacggggagaaataacccgacgcagcggatccaccgccatcatctccatactggagagttgctctgtagcgcgcatcaggccgatttctgcggttagcgccgaaccagcacgcccggcaaacaacaacgcggcaaccaccggccccagttcacgcagtagcgataacgccaccagcatacccagactggtttccgcactataagtggtcagaaccagataaccttgcagccccaacaccattccgatgaacacgccagaaaccacaataatcagcatcgacaggacgccgacattatagagctggcgcaccagcagcggcgcatgtttgcgaaattccggtttgccgaccagcgcattgaataacattaacccggcccgcccgaacgttctcagggttttaatccctttatgtccgagcgacgccagcgcatttaacagcatgagtggcttaactccctggtaaaagatcagcgtgataatcgccggcaggatagcggaacggaacaggcccgtcagctatcccgtccagaaactgacgtacgcgcggatcaggattcgcctgcaacgcctgggcactgccatgagcgacaatttttttgtccgccaggatccaggcgtgatccgcaatacttaacacttccggcacatcgtgagaaaccaccacacaagtcacgcccagcgcgctgttcagctcagaaatcagcttcaccagtacgcccatggtgatgggatcttgcccaacaaaaggttcatcaaacatgatgagatccggctccagcgcaatcgcacgcgccagcgctgcacgccgcgccatcccaccggaaagttcagaaggcattagtttagccgctccacgcagccccacggcctccagcttcatcatcaccgtactatgcaacaatggcgcgggaagttgggtatgttcgcgcagtggataggcgacgttgtcaaatacgttcatatcagtgaacaacgccccggactgaaataacatgctcatccgtttgcgcactgtatacaggcgcgaacgagacatcgccggaatattctcaccatcgaaaaggatctcaccatgatctggtgcgatttgcccgccaatcagacggagtagcgtcgttttaccgatgcccgatggccccatgatcgccgtgatcttccctcgcggcacggtcagggaaatattatcgaagatgcagcgattgccacgcgtaaaactgacatcgcgcatatcgactaaattcgccacagactgctccataattcacccttcgtcttgcgttgattttctaagcatggcgctcaatttaaccttgaacccaacatatttacagaatattacccgccgtggttagcgaaagctggcatttgttttactttttagccgcataaagtcaaaattaagaatccgttacggctttctgaaaatcttcagcggaccggcgagtatacctgaagaaaggacgttagatgcttttagctacggcactgttaattgttggtttacttttggtcgtttacagtgccgaccgcctggtttttgccgcgtctattctttgccgaacctttggcatcccgccgctgatcatcggcatgacggtggtcagtattggtacatcgttaccagaagtcatcgtctcgcttgccgcgtctctgcacgaacaacgcgatttagccgttggtacagccctcggctcaaacattatcaatatattgctgatcctcggtctggctgcgctggttcgtccttttaccgtccattctgatgttctacgccgtgaattacccttaatgttgttggtcagcgtggtggccggttccgtactctatgacggacaacttagtcgcagcgatggtatctttctcctctttctggctgtgctatggctgctgttcattgttaaacttgcacgtcaggctgaacgtcaggggactgacagcctgaccagagagcagcttgcagagctgccgcgtgacggcggattgcccgtcgcgtttttatggctcggcattgcgcttatcatcatgccagtggccacgcggatggtggttgataacgccacggtgctggcgaattactttgccatcagcgagttgacgatgggtctgacggcaattgctatcggaaccagcctgccggaactggcaaccgcaatagcgggggttcgcaaaggtgaaaacgacattgctgtcggaaatatcattggcgcaaacatttttaatattgtcatcgtgttgggtttacccgcgctgataacgccaggagagattgatccactggcgtacagtcgtgactacagcgtgatgttgctggtgagcattatttttgcgttgctgtgctggcggcgctccccgcaaccgggccgtggtgtaggggtattattaactggcggatttatcgtatggctggcgatgttgtactggttatcgccaatactcgttgaataactggaaacgcattatgtcgcacgtagagttacaaccgggttttgactttcagcaagcaggtaaagaagtcctggcgattgaacgtgaatgcctggcggagcttgatcaatacatcaatcagaatttcacgcttgcctgtgaaaagatgttctggtgtaaagggaaagttgtcgtcatggggatgggaaaatcggggcatattgggcgaaaaatggcggcaacgtttgccagcaccggtacaccttcatttttcgtccatcctggtgaagccgcgcatggtgatttaggcatggttaccccacaggatgtggtgattgctatctctaactctggtgaatccagcgaaatcacggccttaattccagtgcttaagcgtcttcacgtaccgttaatctgcatcaccggtcgcccggagagcagcatggcgcgcgccgcagatgtgcatctgtgtgttaaagtagcgaaagaagcctgtccgttagggctggcaccgaccagcagcaccaccgccacgctggttatgggcgatgccctcgctgtcgcgctgttaaaagcacgcggctttactgctgaagattttgcgctctcacacccaggcggcgcactgggtcgtaaacttctgctgcgcgtaaacgatattatgcatacgggcgatgagatcccgcatgttaagaaaacggccagtctgcgtgacgcattgctggaagttacccgcaaaaatcttggtatgactgtcatttgcgatgacaatatgatgattgaaggcatctttaccgacggtgatttacgccgtgtcttcgatatgggcgtggatgttcgtcagttaagtattgccgatgtgatgacgccggggggaatacgtgtgcgccctggcattctggccgttgaggcactgaacttaatgcagtcccgccatatcacctccgtgatggttgccgatggcgaccatttactcggtgtgttacatatgcatgatttactgcgtgcaggcgtagtgtaaagattcaaggataaacaacaatgagcaaagcaggtgcgtcgcttgcgacctgttacggccctgtcagcgccgacgttatggcaaaagcagagaacattcgtctgctgatcctcgacgttgatggcgtactgtcagatggcctgatttatatgggcaataacggcgaagagctgaaagcgttcaatgttcgtgacggttatggcattcgttgtgcgctcacctctgatattgaagtcgctatcattaccgggcgaaaggctaaactggtagaagatcgttgtgccacattggggatcactcacttgtatcaggggcagtcaaacaaactgatcgcctttagcgatctgctggaaaaactggcgattgccccggaaaatgtggcttatgtcggcgatgatctcatcgactggccggtaatggaaaaagtgggtttaagcgtcgccgtggccgatgcgcatccactgttgatcccgcgcgccgattacgtgacgcgcattgctggcggtcgtggcgcagtgcgcgaagtttgcgacttattactcctggcgcagggcaaactggatgaagccaaagggcaatcgatatgagtaaagccagacgttgggttatcattgtgctatcactggcggttctggtgatgatcggcattaatatggccgaaaaagacgataccgcccaggtggtcgtcaacaacaatgatcccacctataaaagcgagcatacggacacgctcgtctataacccagaaggggcactaagctatcgattgattgctcaacacgttgaatattattccgatcaggccgtttcgtggtttacgcagccggtacttaccacgtttgataaggataaaatcccgacatggtccgtaaaagcagataaagccaagctgaccaatgaccggatgctctatttatatggacacgttgaagtcaacgcacttgtgccggactctcaacttcgcagaatcacgacggataacgcgcagatcaatctggtgacgcaggatgttacctctgaagacctcgtcacgttatacggaacaacatttaactccagcggtctgaaaatgcgcggcaacttacgcagcaagaacgccgagctgattgaaaaggttagaacatcctatgaaattcaaaacaaacaaactcagccttaatcttgtgcttgccagctcacttctggccgccagcattccggcatttgccgtaaccggagacactgatcagccgatccacattgaatcggaccagcaatctcttgatatgcaaggcaacgtggttacctttaccggtaatgtcatcgtcacccagggcaccatcaaaattaatgccgacaaagtggtcgttacccgtccgggcggcgaacaaggtaaagaagtgattgacggctacggtaaaccggcaacgttctaccagatgcaggacaacggtaaacccgttgaaggtcacgcttcccagatgcactacgaactggcaaaagattttgtcgttctgacgggtaatgcttatctgcagcaggtcgatagcaacattaagggcgataagatcacttacctggtgaaagagcagaaaatgcaggctttcagcgacaaaggcaagcgcgtaaccaccgttctggtgccgtcgcagctgcaggataaaaacaacaaaggccagaccccggcacagaagaagggtaattaattcgttatggcaacattaactgcaaagaaccttgcaaaagcctataaaggccgtcgcgtggtagaagacgtcagcctgaccgtcaactccggggaaatcgtcggtctgctggggccaaacggtgccggtaagaccaccactttctacatggttgtaggcattgtgccgcgcgatgcgggcaacatcattattgatgatgacgatatcagtctgctgccactgcatgcacgcgcgcgccgcggtatcggctatctgccacaggaagcctccattttccgtcgcctcagcgtttacgataacctgatggcggtactgcaaattcgtgacgacttgtctgctgaacaacgtgaagaccgcgcgaacgagctgatggaagagtttcacattgagcacctgcgtgacagcatggggcagtcactctccgggggtgaacgtcgccgtgtagaaattgcccgcgcactggctgcgaatccgaaatttattctgctcgacgaaccgtttgccggggttgacccgatctcggttatcgacattaaacgcatcattgagcacctgcgcgacagcggcctgggcgtgctgatcactgaccacaacgtgcgtgaaacactggcggtttgtgaacgcgcttatatcgtcagtcaggggcatttgatcgcccacggcacgcctacagaaatcttacaagacgaacacgttaagcgtgtataccttggggaagacttcagactctgatagggtagaagtttgcgacgttttagcaggagagtacgattctgaacatgaagcaaggtttgcaactcaggcttagccaacaactggcgatgacgccacagctccaacaggcaattcgtctgttgcagttgtcgacgctggaacttcagcaggagctacagcaggcgctggagagtaatccgctgcttgagcaaatcgacactcatgaagaaatcgacacccgcgaaacgcaagacagtgaaacgctggacaccgccgacgcgctcgaacaaaaagagatgccggaagagctgccgctcgatgccagttgggacaccatttacaccgctggtacaccatccggcaccagcggtgactacattgacgatgagctgccggtctatcagggcgaaacgacgcagaccttgcaggattacctgatgtggcaggtcgagctgacaccgttttccgacactgaccgcgctattgctacctctatcgtcgatgccgttgatgacaccggttatctgactgtcccgctggaagatattctcgaaagtatgggcgatgaagagatcgacatcgacgaggttgaagccgtccttaagcggatccaacggtttgatccggtcggtgtagcggcaaaagatctgcgtgactgcctgctaatccaactctcccaattcgataaaaccacgccgtggctggaagaggccagattgatcattagcgatcatctcgatctgttagccaatcacgacttccgcactttaatgcgcgtcacgcgtctgaaagaagatgtgctgaaagaagccgtcaatctgatccagtcgctcgatccgcgccccgggcagtcgatccagactggcgaacctgagtatgtcattccagatgtgctggtgcgtaagcataacggtcactggacagtagaactcaacagtgacagcattccgcgtctgcaaatcaaccagcactacgcctcgatgtgcaataacgctcgcaatgatggtgacagccagtttatccgcagcaatctgcaggatgccaaatggttgatcaagagtctggaaagccgtaacgatacgctactgcgcgtgagtcgctgtatcgttgaacagcagcaagccttctttgagcaaggcgaagaatatatgaaaccgatggtactggccgatatcgcccaagctgtcgaaatgcatgaatcgacgatatctcgcgtgaccacgcaaaaatacctgcatagtccacgaggcatttttgaactgaagtatttcttttccagtcacgtcaataccgagggcggcggcgaagcttcctccacggcgattcgtgcgctggtgaagaaattaatcgcggcggaaaacccagcgaaaccgttgagcgacagcaagttaacctctttgctgtcggaacaaggtatcatggtggcacgccgcactgttgcgaagtaccgagagtctttatccattccgccgtcaaaccagcgtaaacaactcgtttgacccaaccgataaggaagacactatgcagctcaacattaccggaaataacgtcgagatcaccgaggcactgcgcgaatttgttacagccaaatttgccaaacttgagcaatattttgaccgaatcaaccaggtctatgttgttctgaaagtggagaaagtcacccacacctcagatgcaacactgcatgtaaacggtggtgaaattcatgccagcgcggaaggtcaggacatgtacgctgccattgatggcttaattgataagctggcacgccagttgaccaaacataaagataaactgaaacaacactaattgtccgggcaattagcatgtgcatggcggcctgttgtgcggcacaacgggccatttgtacggttaatgctccgagcctgttccactgtttgagtgggcaggttcttaggtgaaattatgacaaataatgatacaactctacagcttagcagtgttcttaacagggaatgtacgcgaagccgcgtccactgtcagagcaaaaaacgcgccctggaaatcatcagcgagctggcggcgaaacaacttagcctgccgcctcaggtggtttttgaagctatcctgacgcgggaaaaaatgggcagtaccggtatcggcaatggtattgcaattccgcatggcaaactggaagaagatactctgcgtgccgttggcgttttcgttcagctcgaaacgcctatagctttcgatgccatcgacaaccaaccggtggacttactttttgccctgctggtgccggcagaccaaactaaaacgcacctgcatactctgtcgctggtggcgaaacgtctggcggacaaaaccatctgccgccgtttacgcgcagcccagagcgatgaagagctgtatcaaatcattacggataccgaaggtactccggatgaagcgtagttattcggtaatgtctcttttagacgttgtgaggagaaacagtacatggtactgatgatcgtcagcggacgttcaggttcaggtaaatctgtcgccctgcgtgcgctggaagatatgggtttttactgcgtggataaccttcccgtagtgttgttacccgatctggctcgaaccctggccgatcgcgagatttctgccgccgtcagcattgatgttcgtaatatgccggagtcaccagaaatattcgaacaggcgatgagtaacctgcctgacgctttctcaccgcaactactgttcctggatgccgaccgtaataccttaattcgtcgttacagtgacacgcgccgactgcatccgctttccagcaaaaacctgtcgctggaaagtgctatcgacaaagaaagcgatttgctggagcctctgcgttcgcgagcggatctgattgtcgatacctcagaaatgtccgttcacgagctggctgaaatgctgcgtacccgtctgctgggtaaacgtgaacgcgaactgaccatggtctttgagtctttcggcttcaaacacggtatccctatcgatgcagattacgtctttgacgtgcgcttcttgccgaacccgcactgggatccgaaactgcgtccaatgacaggtcttgataagcctgtcgccgcgttcctcgaccgccacacagaagtacacaattttatctaccagacgcgaagctatcttgagctatggttacctatgctggaaaccaacaaccgtagctacctgacggtcgccattggttgtaccggcgggaagcaccgttcggtgtatattgcagagcaactggcagactacttccgctcgcgcggtaaaaacgtccagtcacgccatcgtacgctggaaaaacgtaaaccatgaccgtcaagcaaactgttgaaatcacaaacaagctgggcatgcatgcccggcctgcaatgaagctgtttgaattaatgcagggttttgacgctgaagtgctcttacgtaatgacgaaggcaccgaggctgaagccaacagcgttattgcgctgctgatgttggattctgccaaaggacggcagattgaagttgaagcgaccggtccacaggaagaggaagcactggccgccgttatcgccctctttaattctggttttgatgaagattaatcttcatcactttgacatacaactcccttcaaactccccccgacaataagaaaatcacgtactgaaatcgttctcaatcaacgtcatttgtacattttgtgcgcttttcactttcagaagaaccttaagaaaaccttaagaggcattgtttaggttttgtttaagttaatcgaccatactggagatcgtcagaaaatatttccaggagatggcatgattcgcttatctgaacaaagtcccctgggtaccggaagacatcggaaatgttatgcgcatccggaagatgcccaacgctgtatcaagattgtctaccatcgtggcgatggtggcgataaagagatccgccgtgagttaaagtactacgcgcatcttggtcgccggttaaaagactggagtggaataccgcgctatcacggtaccgttgagacggattgcggaaccggttatgtctacgatgtgattgcagattttgacggcaagccttccattacgctgaccgaatttgctgaacaatgccgttacgaagaagacattgcacaactgcgccagctactgaaacagctgaagcgttatttgcaggataaccgtatcgtgacgatgtcgctgaagccgcagaatatcctctgtcaccgcatcagtgagtcagaggttatcccggtcgtctgcgacaacattggtgaaagcacattgattccactggcgacctggtcgaagtggtgttgtctgcgtaagcaagagcggttatggaaacgatttatcgcccaaccggcgctggctattgccctgcagaaagatctgcaacctcgtgagagcaaaacgctggccctcacttcgcgcgaagcttaatccagctggtgttgttgcataaacggctcaccgcctaactgatacatctgccgtaaaatccacgcctgacggctacgcacgtagcccgatggcgaggagactttgaaacgaagtggattaggtaatacagctgccagtaatgcagcttccgaccgggtaagtttgctcgcgggtttgtggaaataacgttgtgccgcagcttcgacgccaaacacaccgtcgccaaattcggcgatattcaggtaaaccgtcaggatacgctttttgctccagaccgtttctatccccagcgttaatccggcttccagcccttttcgaacccagctacgcccatcccataaaaagagatttttggctgtctgttgagaaatcgttgaagcaccgcgaatacggttttcattgcgctcgttgtgcgccagggctttctcaatggaagcgacatcaaagccccagtgctcaggaaatttctgatcttctgcggcaatcaccgccagtcccatccacggcgagatttgatccatactgacccagtcagaatgtgccacgtaacgaaaattgccatgcagccaggcgctgacctgtcgctcgaccattaccgctgagaagggaacaggcgcaacgctaaacaacgcgatgcccccgccccagaaaacggcgaggacaaccattaaccgcaaaagaaaacggcgaacgaaactaaacaccgttaagcggcttttactcattcagccagaaccagcacgcgggaaaccagcttatcaatgccgctcgccgcttctgcaatgttctgcgccagcatatatgctggggtggtgacaatcttattgtcttcatcaaccacgatatcatcgacaggacacggcacatgctccgcgcccatctcttccagcacttctgcggtatcgatatcagtaccgatggtcaaacgcagcgggaaatcgaaaattttcggcagcatcgccggggcaatacacataaaaccaagcggttttccggcctgatgcatcgcttgtgccagcgcctttaattcacggtcaacggtgcattcgctaccaagactggcaaaattgcttaaattcttcgccgcgccaaacccccccggcacaatcaacgcatccagttcagcggcatcggcctgggccagaggacggatttcaccgcgcgttattcgtgccgcttcaatcagcacattgcgcgtttccgtcatcgcttcgccagttaaatggttgataacatcaacctgctgcttatccggtgcaaagcagaccgcctgcgcaccgctgcgtgaaatagctaacaacgtcaacaccgcttcatgaatttcagaaccgtcatagacgccgcatccgctcagaattacgccaattttcttcattgtgatcatcctttcgcaattgactgaaacacattaatttttttaataaaaatggtacgcatcacacatttaactgattcatgtaacaaatcatttaagttttgctatcttaactgcgtgcggcctgaaaaacagtgctgtgcccttgtaactcatcataataatttacggcgcagccaagatttccctggtgttggcgcagtattcgcgcaccccggtctagccggggtcattttttagtggcttttgccacccacgctttcagcacttctacgtcgtgacgccactcttctttcatctcttcaatccattcaccgacgttatcttcccaggccggaaggtcaggagactgaatttgctgacccagctgttgcagatggcgtaaccccactgaccccgccgcacctttaattttatgtccttcctcaacaatgccttttttatcctgcgccgtcagattcgactccagcacgctgacatagcccggcatcatcttctcaaacaccgctaacccgtcggtgatcagcttcggtcctacaagttcgagatactgttccagcatgggaatatcgagcaatgcttctgatttactgttctcttctgtcgtcaccgtactctcctcatcatcctgggtatcccagaatttcttgatcatcgcggttagcgccggaacagaaagcggcttactcagcacatcatccattccagcattgaggtactcttgtttgtctttcagcacgttagcggttaaggccaccagcggcggtaaatcctcgcgcggataacgtttcgtcagttcacgagagatatccagcccggtcatatctggcaactgaatatccagcaacaccaggtcgtattcgcccggtttaaacatctccagcgccgccttgccggtcatggcgacatcaacgctgttacctaatttttccagcacagaacgcgcaacaatcacgttcagttcaatgtcttccaccagcagcacattcagcgccggtaaaggcatatcgtcttcatcaaacgcatcatcgacctcttctgctaccgacggtgcgtggatcgtcaacgtaaaggttgaacctttgccctgttcgctggtaaccttaatatcgccgcccatatttttcgccagacgacgagaaacggccagaccaataccggtgccggtggcaggtttaccgccatgactgtctttcacctggtaatacatggcgaaaattttatccagctcatcctgcggaatgccgataccagagtcttccacttcaaaatgcagcatatcgccttcatcgtagcgcacgcgcacggtaacctggccttgctgggtgaatttgacggcgttactgatgaggttccacaggatctgccgtaaacgcgtcccgtcggtaatgacctgatgcggtaatggcagcgtcggctccaggttaaagcgcaatcctttttgttgcgcctgcaatgcggagagattttccagatcggcaaggaagctggtgaaatcaaccggttgattatcaagctggaccttgcgccgttccatcttatccatgtcgataatatcgttaaagatattccccagcgtgacggccgaaacatggatggtcttgagatatttttcctgctcggcggtgagttcggtatccagcagaatgcggctcagaccgacgataccgttcagcggtgtacgcaattcgtgactgatggtggagataaacgtcgttttgtcgcggctggcccgttcaagcgcatcctgataccgcttacgctcggtaatgtcgcgaccaaagcccatcaaaccgtgacgtttacccacgcggtcgtagtacggcactttacggatttcaaagcaggctttgcgcccgtccgggtaatccagccactgttcataggtcagtgacacattatgacggaacactttttcatcggtttcaatgacttttgcggcggcttccggtgagtaaacatcagcaggtttcaggtgaaccagttgtttttcgctttttccggtcagcagctccatcgcgcggttacagccggaaaactctttatcttcgttacgataaaaaaccaggtcgggtgaagcatcaaggaaggaacgtaagaatgaggattgctgctcgagctgaatttgtgtctcttcgcgctctttgatttcaattttcagttggccgaaggtttcctgcagttctgcttccgctttttcacgaacggcaatttcctgatttagctgggcaatattatcttttaactgaacgttgaggctcaaatcgcgctcgcgcatctcctccagtttttgcaccagccgtgacagacgttgtcgtgactcctccagttgctcgacgaccaccgatagaaagtagaccgcccacggcgtaatcagcaaaccaaagaagatagaacgaataacatcaatgctttcgacctgaccatgcagcaccatggttaccgccatttgtaccacaatggcaagaacgacgagggccagcgccagcaacattgagaagcgcaccagacctaacttcatcatcaggtcaacataatactgcgccagcagacgaatttgcttcattagggaattccttcacgacaacctgccccaataatacccaattctgacagttacgttataaattgtgtgagaaatgcggaattcccctcaacgacctactccgttggaggtagccacggacgtcccagcgccgatccctgtacgccatgttcattcagatagcgatccagctcgaccattcccgtccatcgattttcgcaccacagcggagcaagcagcgtcgggcgacgggcgctggcggaaatgcggtggtagatcacttccggtggcgtatggcgaatcatttctccggcagtgagcgtgtaatcctccagttcaataccgttcaaacgccccgcttcccaggctttcgccataatgctgcctttcacaatatgcagcggatgcagctttatgccgtccacgccggtttcaaccactcgctccagcgtttgcaaacattcagcctgcccttcgccaggcaggccgacaattaagtgggaacacaccttcagcccgcgctgacgtgccagctgggttgtacgctgataacaggcaaaatcatggccgcggttgatgcgatgcagtgttttgtcgtgggcggtttgtagccccagctccagccacacttcgtaaccctggtccttatattcgcaaagcagatccagcaccgcatccggcacgcagtccgggcgggtacccacacacaaaccgacaatattggcctggctcaccgcctgctgatacatagaacgcagcacctgaacttccgcaaaggtgctggtatacgcctgaaagtaggccagatagcgtttagcgcggttaactaaattcgcctggtgcgccagttgctcggcaatggaacgatgctgctgcgcttcatcggcaaacgaggcaacattacagaatgtgcagccaccacgcccgatggtgccgtcacggttagggcagctaaaaccgccgtgcagcgtcagcttatgcaccttttgcccataacgacgggtgagatcaccaccaaacatattgactaatttctgtaactgcataatctgatagaccgcgccttgaaaagaggccaaagcctgccatttttagctcaattcggcgatgacctggatcaatcgtcccggcctgcttttatcaactgcataatcaatcaaaattaccgaaatttcatgcataatcacataaatcacttttgcttatcttgtgtcagatttttttatctcctgatggattttaggcaaaaacagtagcatgaaacgtcattaccaattaaggcagtataaaatgctggttttgtcgtcagttcaaggcaggataagggttaacacacctttatgacagtcaggaattgactgtttctctaacgacttcccttttagccttaaagataaaatccattttaatttcagtcatttaataaagaattttgcgctaaagcacatttctgtaccaataagcttgccatttgacctgtatcagctttcccgataagttggaaatccgctggaagctttctggatgagcagcctgctcatcatatttatgcagtaattgagatcccctcttcaccgtattaaccgatgcgaaaaggacaacaagggggcgaatgcgaggcgcgcgtatgacacgcaaaccccgtcgccacgctctttctgtgcccgtgcgcagcggttcggaagtggggttcccgcagagcctgggggaggttcacgatatgttgtacgataaatcccttgagagggataactgtggtttcggcctgatcgcccacatagaaggcgaacctagccacaaggtagtgcgtactgcaatacacgcactggcccgcatgcagcaccgtggcgcgattctcgccgatggtaaaaccggcgacggttgcggcttgctgttacaaaaaccggatcgcttttttcgcatcgttgcgcaggagcgcggctggcgtttagcaaaaaactacgctgtcgggatgctcttcctgaataaagatcctgaactcgccgctgccgcacgccgcatcgttgaagaagaactgcaacgcgaaaccttgtcgattgtgggctggcgtgatgtccccactaacgaaggcgtgctgggtgaaatcgccctctcctctctgccacgcattgagcaaatttttgtgaacgccccggcaggctggcgtccacgcgatatggagcgccgtctgtttatcgcccgccgccgcattgaaaagcgtctcgaagccgacaaagacttctacgtctgtagcctgtcgaatctggtgaacatctataaaggtctgtgtatgccgacggatctgccgcgcttttatctggatcttgcggacctgcgtctggaatcggccatttgcctgttccaccagcgcttctccactaacaccgtaccgcgctggccgctggcgcaaccgttccgctatctggcgcataacggtgaaatcaacaccatcaccggtaaccgccaatgggcgcgtgcgcgtacttataaattccagacaccgcttatccctgacctgcacgacgccgcaccgttcgtcaacgaaaccggctctgactccagttcgatggataacatgctggaactgctgctggcaggcgggatggatatcatccgcgccatgcgtctattagtaccacccgcctggcagaacaacccggatatggacccggaactgcgtgccttctttgactttaactccatgcatatggagccgtgggatggcccggcgggcatcgtgatgtccgacggtcgttttgccgcctgtaacctcgaccgtaacggtctgcgtccggcgcgctacgtcatcaccaaagataagctcatcacctgcgcctctgaagtcggtatctgggattaccagcctgacgaagtggtcgaaaaaggccgcgtcgggccaggcgaactgatggttatcgacacccgcagtgggcgtattctgcactcggcagaaaccgatgacgatctgaaaagccgccatccatataaagagtggatggagaaaaacgtccgccgactggtaccgtttgaagatctgcccgatgaagaagtgggtagccgcgaactggacgacgacacgcttgccagctaccagaaacagtttaactacagcgcggaagagctggactccgtaattcgcgtactgggcgaaaacggtcaggaagcggtcggttcgatgggcgatgataccccattcgccgtgctctccagtcagccgcgcattatttacgactacttccgccagcagtttgcccaggtgactaacccgccaatcgacccgctgcgtgaagcgcatgttatgtcgctcgccaccagtatcggtcgtgaaatgaacgtcttttgcgaagcagagggccaggcgcaccgtttaagctttaaatcgccgattctgctctactccgatttcaaacagctcacgacgatgaaagaggagcactaccgcgcagatacgctggatatcacctttgacgtcactaaaaccacgctcgaagcgacagtcaaagagctgtgcgacaaagccgaaaaaatggtacgtagcggcaccgtgctgctggtgctctccgaccggaatatcgctaaagatcgcctgccggttccagccccgatggcggttggcgcgatccagacccgtctggtcgatcaaagcctgcgttgcgatgccaacatcatcgtcgaaaccgccagcgcccgcgatccgcaccacttcgccgtgttgctgggcttcggcgcgacggctatttatccataccttgcctatgaaacgctgggccgcctggtagacacccatgcgattgccaaagattatcgtaccgtgatgctcaactaccgtaacggcatcaacaaaggcttgtacaaaatcatgtccaaaatgggcatctccaccatcgcctcttaccgctgctcgaaactgtttgaagcggtcggtctacacgatgatgtagtgggcctgtgcttccagggggcggtcagccgcattggtggggcaagctttgaagacttccagcaggatctgctgaatctgtcgaaacgtgcctggctggcgcgtaagcccatcagccagggcggcctgctgaaatacgtccacggcggcgaataccacgcctacaacccggacgtggtgcgcacgctgcaacaagcggtacaaagcggcgagtacagcgactatcaggaatacgcgaagctggttaatgagcgtccggcaaccacgctgcgcgatctgctggcaattacgccgggtgaaaacgcggtcaacattgctgatgttgaaccggcaagcgaactgtttaaacgctttgataccgccgcgatgtctatcggcgcgttaagcccggaagcccacgaggcgctggcggaagcgatgaacagcatcggcggtaattcgaactccggtgaaggcggcgaagacccggcgcgctacggcaccaacaaagtgtcgcgcatcaagcaggtggcttccggtcgctttggggttactccggcgtatctggtcaatgccgacgtcattcagattaaagtcgcccagggcgcgaagccaggcgaaggcggtcagttgccgggtgataaagtcacgccttacatcgccaaactgcgctattcggtgcccggagtgacgctgatctccccgccgccgcaccacgatatctactctatcgaggacttagcgcagctcattttcgacctcaagcaggttaacccgaaagcgatgatctccgtgaagctggtttccgaaccgggagtaggcaccatcgcgactggcgtggcaaaagcttatgcggacttgatcaccatcgcaggctatgacggcggcaccggcgcaagtccgctttcatcggtgaaatacgcaggctgtccgtgggagctggggcttgttgaaacccagcaggcgctggttgctaacggcttgcgtcacaagatccgtttgcaggtcgatggcggcctgaaaacgggtgtcgatatcatcaaggcggcgattctcggcgcagaaagcttcggcttcggcactggcccgatggtggcgctcggctgtaaatatctacgtatttgccatctgaacaactgcgcaacgggtgtagcaactcaggatgacaaactgcgtaagaaccactatcacggcctgccattcaaggtgacgaattactttgagtttatcgcccgtgaaacccgcgagctgatggcacagcttggcgtaacacgtctggtggatctgattggtcgcaccgacctgctgaaagagctggacggtttcaccgccaaacagcagaagctggcgctgtcgaagctgctggagactgccgaaccgcatccaggtaaggcactctactgcaccgaaaacaacccgccgtttgataacggcctgctgaacgcgcagttgctgcaacaggcgaaaccgtttgtcgatgagcgccagagcaaaaccttctggttcgatattcgcaacaccgaccgttctgtcggcgcgtcgctttcaggctatatcgcccagacgcacggcgatcaggggctggcagccgatcctatcaaagcgtacttcaacggcaccgcaggccagagcttcggcgtgtggaacgcgggcggcgtggaactgtacctgaccggtgatgccaacgactatgtcggtaaaggcatggcgggcggcttaatcgccattcgtcctccggttggttccgccttccgcagccatgaagcaagcattatcggcaacacctgcctgtatggcgcgaccggtggtcgtctgtatgccgcaggccgcgcgggtgaacgtttcggcgtgcgtaactccggtgctatcaccgtggtagaaggcattggcgacaacggttgtgaatatatgacgggtggtatcgtctgcattctgggtaaaaccggcgttaacttcggtgcgggcatgaccggcggtttcgcttacgttctcgatgaaagcggcgatttccgcaaacgcgttaacccggaactggtcgaggtcttaagcgttgacgctctggcgatccatgaagagcatctgcgtggtcttatcaccgagcatgtgcagcataccggctctcagcgcggtgaagagattctggcgaactggtcaaccttcgccactaaatttgcgctggttaaaccgaagtccagtgatgtaaaagcactgctgggtcaccgtagtcgtagcgcagctgagttgcgcgtgcaggcgcagtaaggggtagcaacaatgagtcagaatgtttatcaatttatcgacctgcagcgcgttgatccgccaaagaaaccgctgaagatccgcaaaattgagtttgttgaaatttacgagccgttttccgaaggccaggccaaagcgcaggctgaccgctgcctgtcgtgcggcaacccatactgcgagtggaaatgcccggtacacaactacatcccgaactggctgaagctcgccaacgaggggcgtatttttgaagcggcggaactgtcgcaccagaccaacaccctgccggaagtttgcggacgagtctgcccgcaagaccgtctgtgcgaaggttcctgcactctgaacgatgagtttggcgcggtgaccatcggcaacattgagcgctatatcaacgataaagcgttcgagatgggctggcgtccggatatgtctggtgtgaaacagaccggtaaaaaagtggcgattatcggcgcaggcccggcaggtctggcgtgtgcggatgtcctgacgcgtaacggcgtaaaagccgttgtcttcgaccgtcatccagaaattggcgggctgctgaccttcggtattccggccttcaagctggaaaaagaggtaatgacgcgtcgccgtgaaatcttcaccggcatgggtattgaattcaaactcaataccgaagtgggccgcgacgtgcagctggacgatctgctgagtgattacgatgccgtcttccttggcgtcgggacttatcagtcaatgcacggcgggctggaaaacgaagacgccgatggcgtgtacgcagcgctgccgttccttatcgccaacaccaaacagttaatgggctttggtgaaacccgcgacgaaccgttcgtcagcatggaaggcaaacgcgtggtggtccttggcggtggcgacactgcgatggactgcgtgcgtacgtccgtgcgccagggagcgaagcacgttacctgtgcctatcgtcgtgatgaagagaacatgccgggttcccgccgcgaagtgaaaaacgcgcgggaagaaggcgtagagttcaaattcaacgtccagccactggggattgaagtgaacggtaacggcaaagtcagcggcgtaaaaatggtacgtaccgaaatgggcgaaccggatgccaaaggccgtcgccgcgcggagatcgttgcaggttccgaacatatcgttccggcagatgcggtgatcatggcgtttggtttccgtccacacaacatggaatggctggcaaaacacagcgtcgagctggattcacaaggccgcatcatcgccccggaaggcagcgacaacgccttccagaccagcaacccgaaaatctttgctggcggcgatatcgtccgtggttccgatctggtggtaaccgctattgccgaaggtcgtaaggcggcagacggtattatgaactggctggaagtttaagctctgtcccagcgccgcctcctcagaaaagagtcggcgctgaaattctcctttctttctggaaagcgcctcgcataatctgaagaaaaccaatgtaatacgctcatctggattgttaccggtagatgcccggcgtatagctgattccattattcaacgcagcgccatataaagggacagataatggaatcgctctcagagagaacctcaacaggctaccagcaaatccatgacggtattattcacctggtcgatagcgcccggacggaaacggtacgtagcgttaacgcgctgatgaccgcgacatactgggaaattggccgacgaattgtcgaatttgaacaaggtggcgaggccagggctgcgtatggtgcgcagctaatcaagcgactatcaaaggatttaagtctaaggtataagcgtgggttctctgcaaaaaacttacgccaaatgaggcttttttacctcttttttcaacatgttgaaattcgccagacagtgtctggcgaattaacaccattgggaattccgcagacaccatctgcagaattcccatcggcaaagatttggcagacgctgtctgccaaattgagaggctgtttgatatttccacagcttttgtattgcatctcctattttcggtttgtatattcatgcaaataaacgaaggaaagttgccatgatttacattgaacagcttgaattaatccataaaagtggtgatgtgttgtatccagtaaaaataaccagaaaatcatcaggaaaaactgccttccaccttgttccattcggcttaaataagactcacgaccttctagaggtggaagatgcttcagaagcaattcggctggtgattgatgaacgtcattccattcgctgcagtacacttacagcaactattacgaataaaaagggcaagcgaattaagcggacaggtatatacagtatcaagggtgttaacataaaagaatacaacgtcaggtaatggcacagagcggtccgtcagttcaggtttggctctgtgccaaagatgggtcaggtcacacctgatctaataaatttaagccattaaatcagccttaaccttcaccaccacctttttaatctcacccggctcgccgacaacgcatcctggtttatgcggttctcccggcataaacacggcgaacattcccggttttaagttgatggtttgctcgttttcaatggcgctgcaaagctggtaatcatcttcatggtggaactcttcacattggcgcgcagtgcctgccatgccaaacagaatccgttcctcaccgtttaataacagctggatatcaatgtattgctcgtgcaattccgcttttttctcgacgggcgattgagtgttaaacgtcatgacattcataaaaatattgtcgccctgtaattcgtaacgacccggcgctttttcttgcggtctggcagctaaggccagcgttaacgcgtcctgtaacgcaggatgtaacccagcagacggtaatgactgtacttcacccatcatcataatttttctccctgagccaacagcgcagccccaagtaaacctgcatcatggcggtaatgcgccgccagtaaatcaacatgaaatgccgctggctcctgcgccagatacatttccaccaacgccagatacccttctgccagaccaacgctgccaccaaccaccacgcactggcaatcagttgtggctttaatatcagcgatcagccttgcaagcgtacgtgcggagcgatgaatcagttgctgcgcctgctcatcgccctgcccggcgcgtgtgaaaatagttctcgcatccgcgccagccagctcgccctgcgctgccgccgcaatgccgcgaccagaagcaattgcttccacgcaacctgtgcgtccacagccgcagactgggccgtgtggatcggcaagcgtatgcccgatgtgccccgccagaccgccagggccggtaagcagtttgccgccgctcactacaccgccgccgacgccagtggaaacggtgataaagaccatatcggttatatcgccttccagcgcctgatactctgcccatgctgcggcctgcgcgtcgttaatggcaatgctcggcaaattggtaagttgttccagcgttttgactaacggaaagtgtagcaatccaccgagattatgcggattcagcgccagcaaactgccgtcgcgaataattccggttgaagcgatggcaacccgctgcgcatgagcttgcaacggagagactaatgcggataaggcatcacgcaaggcttctggtgtctggctggctggcgtaggaagttcacgacgatcgcggatctgcccgtcagcgccaatcagcgcggcggcaagtttagtaccgccgatatcaatcgccagtgtggtcatagcaccgcctttttcatcgctgtgttgtaccactgacaaatgtgttcaagacgcgtaatggcagaaccgaccgtcaccgcccacgcgccgtggcgcatcgcatctgccgcctgagcaggcgtgttgtaacgcccttcggcaatcacccgacatccggcttcgctcaacgttttcaccagcgccagatccggctcttctggcgtttcaggcgtggtatagccagaaagcgtagtgccaataatttcggctcccagcttttggcatgccaggccgtcttccggcgttgagcagtcggtcatcgccagtaaaccgtgatggtgaatacgtgccagcagcgtttcaacaggcaccggacgcgggcggtcggtgccgtcaatggcgataatgtccgcgcccgcctgcgccagcgcatcaacatcttcaatataggccgtgatgcgtaccggagaatcctccagatcgcgtttcacaatcccgataattggcacgctcaccaccgcacgcgtggcttgcagatttgccacaccttcaatgcgaatggcaaccgcgcccgcctgttctgccgctaatgccatggcggcgacgatttcgggtttatcgagcgggctgtccggaaccggctggcaggagacaatcaggccaccgttagcagcgattttttgatccagttgtgcaagtaacgacatacatcttcccttagcgaaaggcccggtacatagaccgggcaacaggattaacttttggttttgactaaatcgtttttggcgctgccaaacggcacggcaccgctgaatggtttaccgtcgatagcgtcatgagtacgcaacgcttccgggcgcaaccaacgctgaacgcgagaaggcatatccagcccaatcagcaggatcaccacgaacgtcagactgaacgagagcgatgccagcgcagtacccagatccagacgttgagcgatcaacgcgccgatgattggggccagtgcaccgcccaatgcgccaacgttgtaggtaaagcccaggaccgctgcacgctggtcggtatcgaaataaccgccaatcagttttggtaagatcccggcgatcccttgtccaagcatttgctggaagaacagtaacagaccgagcacccagacgtttgcgccgccaatcgcaaataccggaataatcagcagctgcgaggccagcaggctacaaacgtacgctttgcgggttcccagccagtcaccgaggaagccacctacgcagcatcccaccgccgcgccaaagccactaaagaacagcacattggctacagtatgcgggttataagccagatcggttttcagatacgttggcagcagcgcctgaatcggccatgagtagaggaaagcaaacaacacgaccaccatcagcattacgcccgttggccagcgtttgcctgtactctgcaccataaagctgataaagattgcggcgcataacagcccaagaacagcgacgatcgcggcattttgcaggttaccggcgaagcagaaccacagcgcagtagccgccgccagtgtcattacgatattggcaatgcgatgttcaccacggtagagaatatccaccattgtgcgtactggtgctttacctgcgtgtttctctttccagtcttccgcttccgggatgtttttacgcagccagagagcaaagatgattggcaaaatgccgataaagaacagcgcacgccagccccagaccggaaccaccaggctatagacctgagcggcaacgacggcccccacagagaagcctgaaatcaaaaaaccactggctttgttacgcagatgttttggccagctttcaatgacataggtggcgctggaaccgtattcacccgccatccccatgccgatgaccagacgagcgataaacatggtgatgtagcctggcgcaaagccgcaggccagcgtcccggccgagaagagaacgatgctggtgaccattgccagacgacgcccgtagcggtcacccatagcgccgagcatcaggccgccgaaccagcgagagataaaggctgcagagatcagacttgccgcctgcaccgtcgtcagcccgaattcaccttgtacttcggtgagtaccagggcgattaaaacgaaatcaaaaccgtcaagcagatatcccaaccaggcagcggaaaatgcgcgccattgtgcacggttgagatggcgataccacgggatattctgggttgtagtactcattgtgagtctcccgcggtgggcgatgcccacacgctttggtatgaaaattgtagggtacagatgcgtttatttcccctcacccggtaggggcgagcgaggggaaacaactcacccgcgctcttgcatcaactgctgggccagcgccttcagttctggcagatatttttcatctaccggtccaaacggtttgcggcacagcggcacagaaacgacatccatataatggaggacagttttcaggccgcggaatacgcccgttttgatcagtaaatcaatgactttattgcattcagtttgcagtttctgcgcggtctggatatcgccttctttcagcgccttaacgatcccctgatagcgccagcccatgatgttgtaggtactgccgataccaccatcagcgcccgccagcagaccagaggcgaagatttcgtcgtaaccgttatagagcacaagatcaggatgttcacgacggatctgctccatctgatagagatcgccagaggtctgtttcagcgcacctacgccaggcaatgtaacaagtgtgttgatctgatccagggtcagttttaccccactcagggctggaatgttgtacaccaccatcggcaaaccatccgccgaatcaataattgcccgatagtgatcgcagtgttcttcaaagctgaaaggatagtagaacggcgtgacggcggagacggcatcgaagccataacgtttagccgatgccgcaagttgttggctttcggcggtgctgacgcaaccgacgtgggcgatgagtttaatcttacctttcgcctcttcggcgacgatttccagtacctgttcacgctcggaaaggctttgtacaaaggcctcgccggtcgaaccacccacgtataaaccgtcgatgccctgctgaatattgaactgaaccaggcgacgcagactcgctttatccagtgcttgttgttggtcaaaaggagtcaggagtgcagccattacgccacgtaaattcgttgccataaatacctctgaagtgatgcttgtctgataaacgatatacctttatacctgttataccagatcaattaagcaacaccccatacagaaagcttataatgcgatctgcttcactaaagtggcattatttctttttgttggtggtctgaccgaaagcgtgccaggtagcagagacgctgttgagatgcgattgcaacgcacgatcggcttcgtcaggatcatgacggcggatcgcatcaacgatcgcaatatgctgttgataactaacgttgttatgttcgtgcagtgcctgatcggtaaccgttgggcgtgcggcaataagccagtcgagcagggcaacgtggatcgccatgaagattgggttaccggggatctccgccagcacgcggtggaaatcaacgtctgaacgaatgaatgccgcgttgttatccagcgactgactgttgatttccagtgcttttgccagcaaatcgatttgctcatcggtggcatgttcagccgcatagcgcaccagactggattcaaagaacagacgtaattgttcgaaatgggcaatcccaccgggatgagaaaggaaatctttcgccatgccggaaagctcaccgatgatagtgtccgcagaaggacgcgagacgcgagcgcgttcgccgttgtttatttgcaccagacctttgcgttttaacgctgccagcgcttcacgcaccgaaggacgcccgacgttaaagaacgccatcagttcgcgttcagacggtaattgttcaccttcgccaaattcacgacggcggatcatctgttccagctcttcttccaccatttcggagagttttttacgcgccagcgggcggctacgcaagttgcgaccaattgcaggtgaagaatcttcggtttgcgaatcaaatgcgttcataaggcccattctgtaaggtcagtgtgattaacatcatcagtgacatcctatcacaggattgaaagtaggggaaaatggcagggttttctctttgtgcctcatcattaccataattaacggaataattaactattgcgaaaaattaatgtaacgcagataaaaacatcccgtttgaattattcataagactattcacgagcattatgaatattatgaatgtgttcttacaaaataatcataagcgcatatttttaatgaaaaatcacctcacctacaattaaaaacacgacatccgcaccataaatagccttgcaaaaaatataacatcgttgttttcaatctgccgtttatgggattgaccgttttcttttgacacggagttcaacaatgttcggcataattatatctgtcatcgtattaattacgatgggctatttgatcctgaaaaactacaaacctcaggtggtgctggctgccgcaggtatcttcctgatgatgtgcggtgtctggttagggttcggtggtgtactcgatcccaccaaaagcagcggctacttgatcgtcgatatttataatgaaatcctgcgcatgctgtccaaccgcattgccggattggggctgtcgattatggcggtgggcggttatgcccgctacatggagcgcataggggccagtcgcgcgatggtgagcttgttaagccgccgttaaaactcattcgctcgccgtatattattctgtcggcaacttacgtcatcggccaaatcatggcgcagtttattaccagcgcctccggtctgggtatgttgctgatggtcaccttatttccgacgctggtgagtctgggagtaagtcgcctctctgcggtggcggttatcgcaaccacaatgtccattgagtggggaattctggaaacgaactccatttttgctgcccaggtagcgggaatgaaaattgccacatacttcttccactaccagcttccggtcgcctcttgcgtcattatctcggtggcgatctcccactttttcgtgcaacgcgcttttgacaaaaaagataaaaatatcaatcacgaacaggcagagcaaaaagctctcgataatgtcccgccgctctattacgccattttacctgtgatgccgttaatcctgatgctcggctcgctgttcctcgcccacgtcgggctgatgcagtcagaactgcatctggtggtggtgatgttactgagtttgacggtgacgatgtttgttgagttcttccgcaagcataacttgcgcgaaacaatggacgatgtgcaggcgttttttgacggcatgggtacgcagtttgccaacgtggtaacgctggtggtcgcgggtgaaatatttgcgaaaggcttaacgacgattggcactgtcgatgcggttatcaggggtgcggagcattctggtctgggcggtattggcgtgatgattattatggcgctggtcattgccatttgtgccattgtgatgggctctggcaatgcgccgtttatgtcatttgccagtcttattccgaatatcgcagccggactacatgtaccagcggttgtaatgattatgccgatgcattttgccacgacgctagcgcgcgcggtttcgccgattactgcggtggtggtcgttacgtcaggaattgcaggcgtttcgccttttgcggtggtgaagcgaacagcgatccccatggcagtcggtttcgtggtgaatatgattgccacaatcacgctattttattaagccattaaaagacaaaacaggccaccagggcctgtttttgtattacttcacaacgcgtaatgccggtcgaccaccgcgtggtggctgcggaggttcatcgtcaggatgagtgtcatcatcgtgatctggcttgtcgccatcaataaccgacataacggtttcgttgtctgccgatgcctcttcatcattcatgatgctggtatcttcatcgtaggcagcttcaggctcaaacatcgtgcctgcgccattttcacgggcgtagatagccagcacggcagccagcggcacagaaacctgacgcggaatgccaccaaagcgcgcgttaaagcgtacctcatcattcgccagttccagattgccgacagcacgcggcgcaatgttgagtacgatttgcccgtcacgcgcatattccataggaacctgcacgccagggagcgtcacatccaccaccaggtgcggcgtgagctggttatccagcaaccactcatagaatgcacgcagcagatagggacgacgtggtgttagctgtgacaaatccatacagattaactccggcccagacgcatttcacgttctgcttcagttaaagaagcaaggaaagagtcacgctcaaagacgcgggtcatatagcctttcagctctttcgcacccgggccgctgaactcgatgcccagttgcggcagacgccacagcagcggagcaagatagcaatcgaccaggctgaactcatcgctcaggaagtacggcttctgaccgaagaccggcgcaatcgccagcagttcttcgcgcagttgcttacgtgcggcatctgcttcagaagctgaaccgttgatgatggtgttcatcagcgtgtaccagtctttttcgatgcgatgcatgtacagacggctttcaccgcgagctaccgggtaaacaggcatcagtggcggatgcgggaaacgctcatccagatattccataatgatgcgagattcccacagggtcagctcacgatccaccagggtcggaacgctctgattcgggttgaggtcaatcagatcctgaggcggattgtccttttccacgtgttcgatctcgaaacttacacctttctcagccagcacaatgcggacctgatggctatagatgtcagtaggaccggaaaacagcgtcattaccgaacgtttgttggcagcgacagccatgaaaacctccaggtatagtcagaatttttactgctaccagccaccaggtggccagtcagaagttgtgttacccaataaggaacgactctctttgttcgaaaatcaaacaaaaaatgagcaatacccgacatttgggcagaaaattggatgatagtttaccagattttgcgaccattgtggtgagtcgatgccggaaatggggaaaaagagatgcgctttagtctgaaatagttgacttagtcccttattggcgatgtggtttttgttttacctgtctgtcaggtggcagcaaaaagcaactttccagtttttacgctgattcagattttagctataaaaaaacccgccgaagcgggttttttcgaaaattgttttctgccggagcagaagccaattaacgtttggagaactgcggacgacgacgtgctttacgcagaccgactttcttacgttcaacctgacgagcgtcacgagtaacgaagccagctttacgcagttcagaacgcagggactcgtcgtattccatcagagcgcgggtgataccgtgacggatcgcaccagcctgaccagagataccaccacctttaacggtgatgtacaggtccagtttctcaaccatgtcgaccagttccagcggctgacgaactaccatgcgggcagtttcacgaccgaagtactgttccagagaacgttggttgattacgattttaccgttgcccggtttgatgaaaacgcgagctgcggaacttttgcggcgaccagtgccgtagtattgattttcagccattgcctataatcccgattagatgtcaagaacttgcggttgctgtgccgcgtggttgtgctcgttacccgcgtaaactttcagtttacggaacatagcacgacccagcgggccttttggcaacatgcctttaaccgcgatttcaatcacacgctcaggacggcgagcaatcatctcttcaaaggtcgcttgtttgataccaccgatgtggccggtgtggtgatagtacactttgtcagtacgcttgttgccggttacagcaactttgtcagcgttcagaacgatgatgtaatcaccggtatctacgtgcggagtgtattccgctttgtgcttaccgcgcaggcgacgagccagttcagtagccagacggcccagagttttaccggtcgcgtcaacaacataccagtcgcgttttacggtttctggtttagctgtaaaagttttcattaaaagcttacccaataaatagttacacgttggtgaacacccaaacgtcttcaattgttgaggttcacacgacaaagtccggcaaacctaccccttcgaatagcctatgccagcacacaaaaagttttgggaaaaaaactttcttgtaacgtggggtcgcaggattatagagaagtcggggtcaaagatcgacccctttttgtgatttgtggcaggttttaacctgctaaatgctcgcgcttcagatactcttcgctttgcatctcttgcagacgtgacaggcaacgctggaactcaaatttcagccgctcgccctgataaattgcatacagcggcacttctgcactcaccactaatttgacatggcgctcgtaaaactcatccaccagcgcaataaagcgccgcgcttcgctctccatcaaccgcgtcataactggtacatcaaacaacatgaccgtatgaaagagacgtgagagcgcaatatagtcatgctgactgcgggcgtcgacgcacagcgtagtaaaagagaccgccagcgtctggttctcgacgcccattgtcgccaatggccgatggttgatttctaacgtcggtgaattttctcgtttcgcccccgccagcgccaaccatagtttatccatctgcgcccgggtttcatcgttgagtggcgaaagccacagatgcgcctgagtgagtgtacgcagtcgataatcaacaccagcgtccacgttcattacatcacaatgctgtttaatggcatcgattgcaggcagaaaacgcgcacgttgcaggccatttcgataaagttcgtccggcggaatatttgacgtcgctaccagggtaataccgcgggtgaacagggctttcatcagaccgccaagtagcatggcgtcggtaatatcagaaacaaaaaattcgtcaaaacagagcacgtcagtttcggctttaaagcgatcggcaataatttccagcggatcggtctgcccctgtaaggcagttagctcttcgtgcacccgcagcataaaacggtgaaagtgcaggcgctgtttccgctctcccggcaggctttgatagaaaaggtccatcagccaggttttcccgcgtcctacaccgccccacatatataagccacgcactggcgtatgctttgtgtcttcgcgtttaccccacagcttaccgacccgcgccattagcccactcgtcctgggggctggtggcctgctattgatgagttcttgataaataatttccaggcggctgacggcctctttttgaacgtcgtcgggttgatggctgccttcattgagcgccttcaggtattgcgatgttggggtaacgctttgcatgatcttattgttattccttgaataatcggtgcgccgttgttcacggttgacgaaaaaaaggccgttctacactacgcgatatgcagtcgggattccacttctgtggaattaacggttatagtggcataatcagccgcaggcatggagcctgaagccaacaccctacggaaacaaaagacaacgggagatgttcatgacctgggaatatgcgctaattgggttagtcgtcggcatcattattggtgctgtggccatgcgttttggtaatcgtaaactacgccagcaacaggcgttgcagtacgaactggaaaagaataaagctgaactggacgagtatcgcgaagagctggttagccactttgcccgcagcgcggaattactggataccatggcgcacgactatcgccagctgtatcagcacatggcaaaaagctccagcagcctgctgccggaactgtctgctgaagcaaacccgttccgtaatcgtctggcagagtctgaagccagcaacgatcaggcaccggtgcagatgcctcgcgactattctgaaggcgcatccggcctgctgcgtactggcgcgaagcgcgactaatttatttttcgggcgcagccattgcgccctcctcttctctccctccccgactatcatttaatctggtgtctcattgttagccgtctgaaaattcaataacatcaaactgttttgaatctcttttcttatcattcaggtacgagagcaggaataatgaaaaaacaaacccagctgttgagtgcattagcgttaagtgtcgggttaactctctcggcgtcatttcaggccgtcgcgtcgattccaggccaggttgccgatcaggcccctctccccagtctggctccaatgctggaaaaagtgcttccggcagtggtgagcgtacgggtggaaggaacggccagtcagggacagaaaatcccggaagaattcaaaaagttttttggtgatgatttaccggatcaacctgcacaacccttcgaaggtttaggctccggtgtcatcatcaacgccagtaaaggctatgtgctgaccaacaaccatgtgattaatcaggcacagaaaatcagtattcagctcaatgatgggcgcgagtttgatgcaaaactgattggtagcgatgaccagagcgatatcgccctgttacaaattcaaaacccgagcaaattaacgcaaatcgctattgccgactccgataaattgcgcgtcggtgattttgccgtagcggtcggtaacccatttggccttgggcaaaccgccacctctggcattgtttccgcattaggccgcagcgggttgaatcttgaaggtctggaaaactttatccagacagatgcttccattaaccgcggtaactccggcggtgcactattaaaccttaacggtgagttaattggcatcaacactgcaatccttgcgcctggcggcgggagcgtcgggattggatttgccatccccagtaatatggcgcgaacactggcgcagcagcttatcgactttggtgaaatcaaacgcggtttgttaggcatcaaaggcaccgagatgagtgccgatatcgccaaagccttcaaccttgacgtgcagcgtggcgcgtttgtcagcgaagtgttgccaggttctggctcggcaaaagcgggcgtcaaagcgggcgatattattaccagcctcaacggcaaaccgctgaatagctttgctgagttgcgctctcgtatcgcgaccaccgagccgggcacgaaagtgaagcttggcctgctgcgtaacggcaaaccactggaagtagaagtgacgctcgataccagcacctcttcgtcggccagcgctgaaatgatcacgccagcgctggaaggtgcaacgttgagcgatggtcagctaaaagatggcggcaaaggtattaaaatcgatgaagttgtcaaaggaagcccagctgctcaggctggcttgcaaaaagacgatgtgatcattggcgtcaaccgcgatcgggtgaactcgattgctgaaatgcgtaaagtgctggcggcaaaaccggccatcatcgccctgcaaattgtacgcggcaatgaaagcatctatctgctgatgcgttaatgtcgtaaaccgggcatcaggcttacgtgtgatgtccggttaactcgtggtatgctgctgccgttcccttttttaatgacgcctccatcatgtttgtgaagctcttacgttccgttgcgattggattaattgtcggcgctattctgctggttgccatgccttcgctgcgcagccttaacccgctttccactccgcaatttgacagtaccgatgagacgcctgccagctataatctggcggttcgccgcgccgcgccagcggtggttaacgtttacaaccgtggtttgaacaccaactctcacaaccagcttgagatccgcaccctgggatccggtgtaatcatggatcaacgcggttatatcatcaccaataaacacgtcatcaacgacgccgatcagatcatcgtcgccttacaggatggacgtgtatttgaagcattgctggtgggatctgactctctaaccgatctggcggtacttaaaattaatgccactggcggtttacctaccattccaattaatgcacgtcgcgtaccgcacattggcgacgtagtactggcgatcggtaacccgtacaacctcgggcagaccattacccaggggattattagtgccacgggtcgaatcggtctgaacccgaccgggcggcaaaacttcctccaaaccgatgcttccattaaccacggtaactctggcggcgcgctggtgaactcgctgggcgaactgatgggcattaatacgctgtcgtttgataagagtaacgatggcgaaacgccggaaggtatcggctttgcgattcctttccagttagcaaccaaaattatggataagctgatccgcgatggtcgcgtgatccgcggctacattggtatcggcggacgtgagatcgcaccactgcacgcgcagggcggtggtatagatcaactgcaagggatcgtggttaatgaagtgtcacctgacggcccggcggcgaatgcgggtattcaggtcaacgatctgattatttcggtggataacaaaccggccatctctgctctggagacgatggatcaggtggcggaaattcgccctggttcggtgatccctgtagtagtgatgcgtgatgataagcagttaacgctgcaggtcaccattcaggaatatccggcaaccaattaagtcgtgcgctcaaaacaaaaaaccggagtctgtgctccggttttttattatccgctaatcaattacttattaacgaactcttcgcccagggcgatatctttcttcagcgtatccagcataccttccagcgcgttctgttcaaatgcgctcagggtaccgatagatttacgctcttccacgccgtttttacccagcagcagcggttgagagaagaaacgggcgtactgaccgtcgccttcaacgtaggcacattcgacaacgccttgttcgccctgcagtgcacgaaccagagacagaccaaaacgtgcagctgcctggcccatagacagggttgcagacccgccaccggccttcgcttcaaccacttcagtacccgcgttctggatgcgtttggtcagatcagccacttcctgctcggtaaaactaacgccaggaacctgtgacagcagcggcagaatggtaacaccagagtgaccgccaataaccggcacttcaacttcgcctggctgtttgcctttcagttccgcaacaaaggtgttggaacgaatgatatccagcgtggtaacgccgaacagtttgtttttgtcataaacaccggcttttttcagcacttcagcagcaattgcaactgtggtgttaaccgggttagtgataataccaatgcacgctttcgggcaggttttcgcaacttgctgtaccaggtttttcacgatgccggcgttaacgttaaacaggtcggaacgatccatacccggtttacgcgctacgcctgcagagataagaacgacatctgcgccttccagcgccggagtcgcatcttcaccagaaaaacctttgattttcacagcagtagggatatggctcagatcgacagccacaccgggagtcactggagcgatatcatacagagagagttctgaacctgaaggcagttgggtttttaacagtagtgcaagcgcctggccaataccgccagcagcgccgaggactgcgactttcatcctaaactccttattatattgataaactaagatatgttgctccgctgccgcgaccttaatccacaaaattgccgtttacaatgaccacatctcaagaatgtgtagtcacgcaagtttagcgtttatgcatttaattgccgtaatcaggaacctaacttacgtaattaacagtcgcttatgcattagcgcaacattccaacaggtggtgacaatataccctaccgttcagccaaaacaacatcaatttgataacaattaatttacttttaagcagaatttgcatgccgtgacgcaggcatgtttctcaataacgaaatttgataaaatcccgctctttcataacattatttcagccttcttcagggctgactgtttgcataaaaattcatctgtatgcacaataatgttgtatcaaccaccatatcgggtgacttatgcgaagctcggctaagcaagaagaactagttaaagcatttaaagcattacttaaagaagagaaatttagctcccagggcgaaatcgtcgccgcgttgcaggagcaaggctttgacaatattaatcagtctaaagtctcgcggatgttgaccaagtttggtgctgtacgtacacgcaatgccaaaatggaaatggtttactgcctgccagctgaactgggtgtaccaaccacctccagtccattgaagaatctggtgctggatatcgactacaacgatgcagttgtcgtgattcataccagccctggcgcggcgcagttaattgctcgcctgctggactcactgggcaaagcagaaggtattctgggcaccatcgctggcgatgacaccatctttaccacccctgctaacggtttcacagtcaaagacctgtacgaagcgattttagagctgttcgaccaggagctttaatctctgccccgtcgtttctgacggcggggaaaatgttgcttatccctctcaaccccctgctttcccctgcgattaatttaacgaatagtgcgttttactgcgacatgtcattcacacaatgaatacataaggtaaaaaaagcacattatgcaaaattcattatctaattgaaaaaactagaattaacgataaataaccgtatttttaattcttttttgttattaaaattcacatttttaacacttagtatcaactgaaacagttagcgcggtattaattagctcaataattagtgtatacttgattttgtgatatgggtcacgaaacaaaggcccagctaaaagattatgtcgaggtaaaaatcatgaaaatcaaaaccactgttgctgcattaagcgtactttctgttctctctttcggtgcattcgctgccgactccattgatgctgcacaagcacaaaatcgtgaagcaatcgggaccgtatccgtaagtggtgtggcgtcttcgccaatggatatgcgtgaaatgctgaacaaaaaagcggaagagaaaggcgcaacggcctaccagattactgaagctcgtagcggtgacacctggcacgctacggctgaactgtacaaataaaccctcatcgtcttgtccgacgatattgcccccggttcgggggcttttttttgcgctaatgacgaacattaaaacgcaaatgcccttccagctcttcctctgcctcatcaaacagcaatattaacgcgccaaaacggcgacgcgttttctctcccagatgaacaaattcaatctcaagtggtagcggcaggacatcgttcattaacacatcccatagtgagtcgagatcgcgtaccttatctttcgccagaccaaaggtttggctaaagtcacgataaaaatcctcctgactctcaatctcatcaaaatcaaaggtataaatattcatctgttgccaccgtcacgtttcgcggcgagttctgccgtgcatcgctaagtatagccatgaaaaaaccgacgcttttggcgtcggttttgacttaactatcggtcaacgcatgttgatacttatggagcatccccgccagccgatgaaccggttccgtcacctgcggtggagcttgccagatgcgtagcttttcctggtagatttccagttcttccagcaactgaccaaagtaccgacgacgtttatcatcgctacgggcagatatcacatggtctgctgtgcggcgcatttgtcggtgaaacgccgataaatcctcgttaaccgggatcggcgcatcacgcaggcgctggtgggcgataatcatcgtcagcgccaggcgaaatttcggcaaatcccctgggaacttattcatcagcaaaaacagctgctgataaagtgccgggaggtggttctctttacgacgtgccacattggtagtcatcgcggaaacagcggcagaaacaaactgattaagcagtacacgtccagtcctgtcgcgcgatttatcccgcaccagcaaaataacggtgaacgcgagcacacagccgacgatttgccctaatgcgctgtcgagaaactgactgaaatggaaagtcatcgggttatccagcacgataatatttatggtgctggccagtgcccccatcgagcccagtcgccgtttctgtacttctataccgaggaagaatcccagcactgccaggctaatacacagcagcaacatgctctgttgggtattagggataatcaccaaaaagtagagcagccctaacggcagcgcggccagcgtcccgtagataaagtcgatcgccaccatgcgtggattcggcaaacgcattgccagtgacgtcacgaccgcaatcatcaccattgcaccactaccggaagtccagcccgtccacagccagaaaagcgttcccagaatgcaggaaagtgtggttcgccagaagttaaccattgcatgatgacgttcggctggctctacttttacttccggttcgccttgcaggatctcttcttcggtggcgttgatttttgtgttactgataacgccgcgcttgagaagctgataacgcgttgccgccgcgacccagctataaatggtgacaggcgtttcccgttccccggtccaggcgataactcttcgcaggcgtttgagctgcttgtggacgtcctgcgcggtttctaccggtgtgtcaaaaaattcgcggaaagtatcagtgatcaattccgggcgcgtattctgaataagataagtttcgcaggattgggtaatcagcgtcagcgatagcgtattgatcgcttttaaacgtcgattggcccgcgcccagcgggaagattccatattcaggttgctgcgcataccttgtagcgccgtggtgcgtcgaaccaggtcgccccaggctttatcgacaacttcaccatcgccatgcttgatacagagttgcattaattgatattgcgcgaccagcaaactttccagctctcgatccacttcttgtttgatcgatcgcggagaaaagagcaaatccgccataattgcacacacaataccgataacgatctcgctacaacgttcgacggcaaactgcggcgtaagcaatggttcaggctgaatggtgatcacaatgatcagcgcggtataaccggccagcccccacgcatacgagttttctattcgtaccagcgaggatatccaggtacaaaaaccggcccagatacagcacaccagaatcatcaataatggtgcgtggatcatcgcaatgatgatcaccagtccggcaatacagccaataaatgtgccgatgatgcgcaaaaagccacgatagcgaatagcgccagaatacggttcacctcccgcagcaaaggccggaccggcagcaacaatcgccgctgtcagtaccgcccagcgtggcgtttccagctggaagtgaaagccaacaaacagcgccagtacaatggcggtcgccagttttaccgcaaagcgaatatgttggttagcaatggagaaaatacccatcgtgattaaccaaactcacgcaggcgatgggccattttacggaagaacgaatcctggctttcgtcgcgatcttgtttgccagtgaccaccactgtagcagtggtgcccgcaggccagatgttctcttgctggttgtcgagacgaatacgaaccggaacacgttgcgccaaacgcacccattcaaggttagagtcgatggtcgccatccctttgtcgtcacgcgtgctgctggcgttggtgaccccagcggcaacactatcaacagtccctttcagcactttgttactgccaagcggcgtgatctctgcacgatacccagggcgcaccccttccagcttagtttcttccatataggccagtacatagaaagagttctgtttcaccagcgcaaccgccgttgatccacgagtaataaactcaccggtatagacgttgaggttggtcacccagccatccactggcgcgcggatcaccgtgcgttcaagatccagttttgccagatcgcgggtcgcctgcgctttcgctaactgatgcagaaccgtttgtagtacgttgttggcctggtcgatctcttcgcgagacatcgcctgcacaccgagacgattacgacgtccggcctcctggcgtttctcctgtgccagtacctgataataagcaacatcggcttgcgcttcctcaagcgccttttgatagcgcggctggtcgatggtgaacagtacctgtccttttttcaccagctggttatcatgaacattcacctgggtaatgagtccagaaacgtccggcgcgatcgcaacgacatcagcgctaaagcgcgcgtcacgcgtccacggggattcggtgtaatagacccaggcattaaaaattgcgatgaaggccagaatgactaatacgaccgtgatggccgtacgggagaattttcttattagtgttttcacttcaacctcaaacgaacagtcgcgatatcaaataaaacaagcagcaatagagcgcggtgttgaacaacgccggatgccagacaaagtcgtagatacctgttggcacaagtacccggcgcaccagccagaaaatcgccagtgataaaagcaattcaaaaaatatcggtgggaaggacagcccaaacaccacgataacgggaaacagactcatgtcgaccttggttgtatagagagagcaggcgttattattttcagcatctgtcgccgcagagaagggcatggaaagccgggcgagagcaacattgctgtagattgatatttaatatattagcgtaactgttatgctgttatctatattatgtgatctaaatcacttttaagtcagagtgaataatggaacgactaaaacgcatgtcggtgtttgccaaagtagttgaatttggctcttttaccgccgccgccagacagctacagatgagcgtttcgtccatcagtcagacggtgtcaaaactggaagatgagttgcaggtaaagctgttaaaccgtagtacacgcagcattggtctgactgaagccggcagaatttactaccagggctgccgtcggatgctccatgaagtgcaggatgttcatgagcaactgtatgccttcaataacacccccatcgggacgctgcgcattggctgttcttcaactatggcacaaaatgttctcgccgggctgacagcaaaaatgctgaaagaatacccaggtttgagcgtcaatctggttaccggaattcctgcccccgacctgattgccgatggtctggatgtggtaatccgcgtcggcgcgttgcaggattccagcctgttttcccgccgtctgggcgcgatgccgatggtggtgtgcgccgcgaaaagctatctcacacaatacggcataccggaaaaacccgccgatttgagtagtcattcatggcttgaatacagcgtgcggcccgacaatgaatttgaactgatcgcaccggaagggatctcgactcgcctgatcccacaaggaagatttgtgactaatgatccgatgacgctggtgcgctggctgacggcgggtgccgggatcgcctacgtgccgctgatgtgggtgatcaacgagatcaatcgtggggagctggagatcctgctgccgcgttaccagtcagatccacgcccggtttatgcgttgtataccgaaaaagataaactgccgctgaaggtacaggtcgtgatcaactcgctgacggattattttgttgaggtcggtaaattgtttcaggagatgcatgggcgcgggaaagagaagtaattcatattgtactgttacgttgttcaaacctgtgccaacgggttcccctcaccctaaccctctccccaaaggggcgaggggaccgttcgtgcacgtagaaagattaattatccttctgaaaatagtgaaattattacgcagtaccgccaacagtcaggttatcgactttcaacgttggctggcccacgccaaccggcaaactttgcccttctttaccgcagacacccacgccgttatccagtttcaggtcgttgccaaccatcgaaatctgctgcatggtttcgataccggaaccaatcaacgttgcgcctttcaccggcttcgttactttaccgttttcaatcagatatgcttctgaagtggagaaaacgaatttgccggaggtgatatccacctgaccgccaccaaagttcggtgcatagataccgtactcaacggattcaataatttcctgcggggtcgatttacccggcagcatataggtgttggtcatacgcggcatgggcagatgggcgtaggattcacggcgaccgttgccagtcggcgtcatccccatcaaacgcgcgttgagtttatcctgcatgtagcctttcagaatgccgttctcaatcagcacgttgtactggcctggcgtaccttcgtcatcaatcgccaccgaacctcggcgatcgaccatcgtgccatcatcaaccacggtacacagttctgaagccaccagctccccgacctgtccactaaatactgaagtgccacggcggttgaagtcgccttccagaccgtgaccaaccgcttcatgcaacagcacgcccggccaacctgcgccaagtactaccggcatggtgcccgctggtgcagcaacggcagaaagattgaccagcgccatacgcactgcttcttttgcccatgcatccgcacggacttcgccgtcgagatcggcaaggaagaattcataaccaaaacgaccgccgccgccactggcaccgcgttcgcgtttgccatcttcttcgacgagaacgctcacggaaagacgcaccagcggacggacatccgccgctagcgtgccgtcggtggccgcaaccaaaattaattcatagacaccactgaggctggcagtcacttcctgtacgcgcttgtccgcttcgcgggcaaccttatcgacgcgacgcaggatatccagcttctcttcacggctcatgctttgcagcggatctaccgaggtatacaacgggctatgctctaccgcgcccagcgtctgtactttaccatcaccactatcacggacgatggtgcgcgccgcttgcgcactctgttccagcgccagcaggctgatttggtcagcgtaagcaaatccggttttttcaccgctgattgcacgcacaccaacgccctgatcgatgttgtaagaaccatctttaataatgcggtcttctaaaacccaggattcgtgatagctcgactgaaaatagagatcgccataatcaaggcgacgttcggccagttgaccgaggatcgcgaacaagtcctgatgtttcaggccgttcgccgctagcaattgttcacttaccaggttaagactcatcgtttttgctactcgttagttactgcagtagaggattttttacggctgccggatgcggcgtgaacgccctatccagcctacggttatgttccggtttgtaggcctgataagacgcacagcgtcgcatcaggcaacggctgtcggatgcggcgtaaacgccttatccgacctacggttatgttccgtttgtaggcctgataagacgcacagcgtcgcatcaggcaacggctgccggatgcggcgtaaacgccttatccgacctacggttatgttccgtttgtaggcctgataagacgcacagcgtcgcatcaggcaacggctgccggatgcggcgtgaacgccctatccgacctacggttatgttctggctcgttggcctttggcaacgattatcctatgagattggggcaattacgcgccctcgtcaaatcattgcgctttttctttacgcggttggcgcaacacttcgttgatttgcggatcgtccagcggacccgaaatgtgatagcgcaaaatggagactttgctccacagcggccccagcactttactggcggcaaacactgccgcgccaacaatggggttaaccgcaaaagccgcagccacgcccaccgtcgcagaaatctctggtgcgacaaccgcttccatattcaggtcgcgacgtaccagatttaccgaccctttcatggcgatatccgcctccaggccatccaccagcgtgtcgtcggtgtgcataacgccgtctttaatccacgcggtgctgcgaatggagtcaaaatagaacccttcgccaaaagtgtctctgaaatcaaaacgcagcttacgcatcagggcatctacgctcaataagcgcagcaattgcccggcatgtccggtattgatttcggtaatttcgcctttacccagttgagtatgaatgatgccattcaacgtcgcctcatctggctgccacggtgctttacgccagtgtaaatcgtaatccacattaaatgacgactgccgtatgggcgtcgtgacaccaaaaaattctgcggcggcatcaattttctgcccgcgcagttttcctttcagcgaggtacgttcattccccggattattaacccattcaccatcgccagtaagccgcgagaaaccagtatcaatcagtccattggtcagcgttaatgtatcgccagaaatggtgagatcactgtcaatacgaccgaatttttgcccccagaaccagcactctgcgcatcgtatttgtgcgtccggccagccacggaagttaatgcgctccgttgtcgggaaaggtgatgacggcgttgaatcaccacgagttttcgccacgctcgggttgtaataaagatatttgatattcgccagccacggcgcgttattacgcatcgccagcgtggcgttgatttcacgcccttgcgcctcaacctgggtgccatttgccgtcggttgcgaaacaatactcaggttattccattgctgatttcccagcgacaacataggcgtacgtaacgttatgtgttgtgggaaactcgctgcaccaccgacactctccgccgcacctttctgaaacagggccagccactcggcaccattcatcggcggcatattgagttcaacaccactttgttccggcaacggcgggagcgttttactgtctgccgcccaaatagcacggtcgagcgtcagcttttgaccgagcaaccagcggctattgaaatggttatccgcaccagcctgtccggttaaatcaaagctgttgagattgccatcaaccttaacgtttaccggcagtggttcacccgcaggtttggctaacggtgaaggtaagtgactgctcacattcttcaaatcgccgtttagctctacgttatacgtcgcgccagcatgataaggcagaacaatgcccactttaccatcccacgccacgctgccactcaatgcttcgttcaccgctgcaggcagaacgccggttttcgccggttgccagttaccgttgaggtttaccgctacctggtaggcttttgccccttctttggtggaaaaatccacgttcaacggctgattaaaccagcttgctgtcagtggttcactttgcagatcgccattgataaagctgaatttaccgctcaaatttttcagggtgctggcgagtggtttgataaacagactgttattacgcagcgtcacttcacctttcgcggttaccagctcgccgttcagcgggatatcaagatgtaagcgagcattcacatcgccgtcgagctggagttcttgcagggtcgcacccagagaatctttcagcggtgtctcatcaaagtaagggccaacggctttacccggacctttaatgtcagcgtcaatcagcagtttttcttttgagtagtcagggatcactgcggtaagattactcgcgcgcacgccgcccagattaacgccatcggttttcatccataaaccgtcgttaataaagtccagttcaatatcaaggttagttaatgcaggccagtccggctggaaggcaaacttcgcgttgcgcagcggcaccagcacttcaaactgaccttcgttgtgtttataggggaagagttgcggattgccaccataaaccagcgtcgcgttatccgcttcaccgccctgaatcgcgccacttaagtaatcaaccaggtctttacccatcaagttttccgggaaatagcgccaggcttgtgaaccatcatcggtactgatgccagccagaatacccagccagggttcatcgttagcaggttgcaggtaacgaaaaccgccgcgcgcatggacggctttggctttaacgtcaatattacgcccatccagctggaaacctttgttattgttcagccagcttatagttgcctggccgtcggcgatttctagtggcgcacggaataccgtttcgtaaggcatctttgcctgcttcatcgacgcggtaagcaaaccattttcaacgctgccggaaagcgtcccggagaagtgttccgcacccggtaataatttccattgcttccaggccagatcgctccacgatgcctgaaaacgggtcttgtctgccgcctgaagcgggatatccagcgccagagtgttaatcttgccgctcggttgtgtggagcgccaaacatcacccagtgcaggtgaaagtttcgcggccagcgggcgtatgccctccaggcctgccagctccagattactggcgcgaatccggagttcgtcactgcgtttattgtctttgccgccaaagtcctgttccggtatccaggccagcgtcaatgctccgctcggccagggtttgccgtccatcgtgatccgtgtatcgggaatagagaactgccagcccggattttcacgcgtaatatgcgcggtcagattatccaccgacagcgtatgcgtttgcttctcgcccaaccagctggcaccgccctgtttcagccagacgtcaccgccggttacatcgcctttgtcgatcgtcatccagccttcaagggagaactgtgccgtttccagcgcaatattgtcctgcatccatttaccgagccacggcttcaggtcgatgtcatccgcctggagccagacgcgaccattgcttaacaacccctcatcatcgcgcaaatccatgcgcacctgcatcacgccgtgctgtccggtaaggctggagaggcttaccaggccttccgcacggtgtcgacgtggatcgttcagccaggtgagttgtgggatcgccagctcggcgcgctgaccggatggcgtcaggaaactgacttcactgtcgcgaagatcgaaatggtcaaattgacgaagaaacagatcgctgatgtgactggcttccagactgtcatcactaccaccgctggtgataggagtgttggtgcgaaagcgcagctgccagaaagtgaggtcgcgaaactgccagcgcatatgtaacaggctctgccagacatccagcgccagagtaacgcgtttaaccgaaaattcgccgccatcttttagttctgcacggatgtcgtgtgcttcaagcgtcgggccaaaattctgccagctggctgagagctgactggcttctaccggcatgccagtcgcggattctattttgttgaggatttccggacgccaggcgtcaagatgcggtaaagcaatacgcaggccgctaaccagcagggcagcgatcacaacgagcgcggctccagtaagcagtaaaatccccggcaatcgcctcacccgtcactccttgtctgctaaaaatgtgactcaaaaaccctttgccggatggcggcccagcatctgtttacatcattacgacgtcaaactgctcctggttatagagcggttcaatttgtactttaacctgtttgccaacgaaaatttccacttccgccagcgagtgtgactcttcgcctttcaaggcttcagctactgccggagaagcatagaccaggaaacggtcggagtcgtaagcatggtggacacgaacaatctcgcgcatgatttcatagcataccgtttccacggttttcaccgttccgcgaccgtggcaggttgggcattcgttacacagtacgtgctcaatgctttcgcgggtgcgtttacgcgtcatctccaccagccccagcgccgaaaaaccattaacgctggttttcacccggtctttgctcaacgcctgctccagcgagtgcagcactcggcggcggtgatcttcattattcatatcgatgaaatcaataatgataatcccgcccagattacgcaaccgtaactggcgagcgatagcctgcgtcgcttcaatattggtattgaaaatggtgtcgtccagattgcgatgaccgacaaacgctccggtattgatgtccacggtggtcatcgcttcggtctggtcgataatgagataaccaccggatttcagttctactttgcgttccagcgctcgctggatttcgttttcgacatcaaagagatcgaaaatcggctggcgtcctgtgtaatgctccagcttgcttgtcatctcgggaatgtactccgaggtgaactcaagtaacgcttcgtaagtcaggcgtgagtcaacgcgaatgcggtccagttcggcatcggcgaaatcacgcagaacacgctgcgccagcgccagttcgccgtacagctgataacgggtctgcgggcgttttttacgctccataactttggtccagacgcgtttcagataagcggcatcggaggccagttcagcctcgccaaccccttccgctgcggtacggatgataaacccgccctgctcgtcgcaatactctgcgaccacttttttcaggcgttcacgttctgattcgctttcaatacgttgggaaaccccaacgtgagaagcccctggcataaacaccagatagcgagaagggagcgtgatatcggtggtcaggcgcgcacctttagtgccaagcggatctttcaccacctgcaccatcagatcttgcccctgacgaaccagttccgagatgtcgcgcaccgtgaattgcttttgttcttcacccgccacacattcggtgtgcggcatgatgtcggatgcatgaagaaacgcggctttatccagcccaatatctacaaaagccgcctgcatacccggaagtacacgacttacacgacccttgtagatattgcctactattccgcgtcgcgcctcacgttcaatatgaatttcctgcagaataccgccatcaatatacgccactcgcgtttccgaaggcgttacgtttactaacaattcagccgtcatgtttatcccttttctcacgcagtgcgttaaaattacttaataattcatacgtttcaaccagcggtaagccgactacggcgtgatagctgccatttatcttcctgacaaaacagccacccagcccctgaataccgtatgcacctgctttatctaacggttcatcgctggcgacatagcccgcgatgtcttcgtctgttaacgttctgaaagtcacatcggtgaccaccaggcaatcgagaatgtgctggctgtcggccaacgccactgctgtcatcacctgatgggtctgacccgataatttgcgcaacatctgcgccgcatgctctgcgtcgcgcggtttctccagcacttctccgttcaggataacgatagtatccgcacccagcaccgggagatccttcgccgtttgcgcgacacctgcccgtgctttctcgcgcgccagacgcacaacatactgctgcgcgctctcctgcggctgacgctgctcctcaatgcccgtaacaatacgttcaaaggtcacgccaagttgcgcaagtaactcctgacgacgcggagaaccggaagctaaatacagagaagtcatagaaacctttattgcactgcaaactgctgacggactttgcgcatcagcaagaaaatccacggccagagcaccccattgactacactactccagaacacttccggtctgaaagagacgttaatcactaaaaactctgcccagaaaacaataatatccaccaccagcgaaagcaacatgacgaccagcgcctgctgccataatgcgaggttgcggaaaagctggtatttcagcgccaccaggtaagcaatgatgctcatcgccaatacgcgtacgccaagcgtcgagccgctgatcagatccagtatggcacccatcacaaaacctgtgcccacatttacgcgatgaggcaaggccaggatccaatacaacaagatgagtaacacccagtttggccggaaaaaaatcaggttatccggccagggcatgatttgcagcaacagcgcaatgaggaaagagagccagattacccagcgtccctggctacgatagctcgccactattgccctcccggcgcacgcgcaggcggttgagcaccactttgcggcggcgtagccctttgtggagagcgattagcagcaggctgtgtcggcgcagcaggcgcagtagctgcatttcctgtcgccggttgctgcggagtcggctgagcgatccccgttgccggttcaggtaactttggccccatcgcgtctggcgaaggcaatacctgcggcatcatctgcatcagacgttcattagcaacacgatgcacctcttccggcgtcatcgggttagcgccgttacgatctgccccccacagcagcagcagataacgcaaacgttgcagccctgcagtcggacgcgcctgaatcacagtataagcgcgctgggtatcgagttttacggaagagacaaccgcgaccggatagccttccgggaaacgaccgcccagaccggaagtcaccagcacatcaccaacacgaatatccgtattcgccggcagatgctcaagctgcaaatcatccgtacaaccgttaccggctgcaattacgcggatatcgttgcgcagcacctggattggcagcgcgtgggtcgcatcacaaatcagcagcacgcgactggtcagtttagcgacggccaccacctgaccaacaacacctttgtcgctgatgaccggctggccttcataaacgccattaacgctacctttatcgataacaacttgatcgctataaggatcgttaaccgtggagataacctgagtcaccattttctgctcatcctgacgcagcggggaacccagcagctcgcgcagacgcgcgttctcctgtttgtattgtccaagcatcagcagttcactgtttttcagcaacagttcctgacgtaacgcccggttttcaagttctaattggtcacgcgaggccagcgtctgcgatacgccatccagcaattcacgaggagcattggaaacaaagtagaaaggactgacggcggtatccatataagtacggatttgactgaacgtccccaggcggctgtcggcaataataatgccgagcgccaccagcaccgccagaataaggcgaatctgtagcgacgggccacggctaaaaattggcttcataagttatgcgtattctcgtatcagaccaggcagggtaaacagacacttcccctgcctgcatccgattactcttcgctgaacaggtcgccgccgtgcatgtcgatcatttccagcgctttgccgccaccgcgcgccacacaggtcagcgggtcttcagcaacaacgactggaatgccggtttcttccattaacaaacggtcaaggttacgcagcagtgcgccaccaccggtgagcaccatgccgcgctcggagatgtcggaagccagttccggcgggcactgttccagtgcaaccattaccgcgctcacaataccggtcagcggttcctgcagtgcttcgaggatttcattggagttcagggtaaaaccgcgtggaacaccttctgccaggttacggccacgaacttcgatttcacggacttcatcgcccggataagccgaaccgatttcgtgcttgatacgttctgcggtggcttcaccgatcagagaaccgtaattacgacgcacatagttgatgatagcttcgtcgaaacggtcaccaccaatgcgcacagaagaggagtaaaccacaccgttcaaggagataacagcaacttcagtggtaccaccaccgatatcaaccaccatagaaccggtcgcttcagaaaccggcaggccagcaccaattgcggcagccatcggttcttcaatcaggaagacttcacgggcaccagcgccctgcgcggattcacgaattgcgcggcgttcaacctgggtcgcgccaaccggcacacaaaccagaacgcgcgggcttggacgcataaagctgttgctgtgcacttgtttgatgaagtgctggagcattttttcagtcacgaagaagtcggcgataacgccgtctttcattgggcgaatggcagcaatattgcccggcgtacggcccagcatctgcttcgcgtcatgacctactgcagctacgcttttcggtgaaccggcacgatcctgacgaatggccaccacggaaggctcattcaatacgatgccttgtccttttacataaatgagggtattcgcagtacccaggtcaatggacaagtcattggaaaacatgccacgaaattttttcaacatactaagggataatcctgaaagctggggcggaaaagaaaatccgcttactttaccaaccacacgcagcagcgacaaggcgcaaaaatcatctgctacggtgaaaattagtgcagttcgtttcctttgttacaaatctctgcctgagtccagaaaggcttaatgcatcagcagcattcctcgcctgtttgcaaccgcgtaaggtcattcatctgcatatgtgctgcaacaatctggcgagcagacaagcacactcccatgagacgcagcgcgcgttattctacgtgaaaacggattaaacggcaggttaaaccgagtatctttgtgaatattttttcacgttagtatcaagtggctgtgaggacgcgaaaaaatccccttgcccgcctgtaacaccgcgctgaatcagggtctgccactcgcttcgcgaacgcacgccggtggcgtaaacctgggtgctggtcccggagcaggcttccaccaggctttgaaccagcagctggttctccgttcgcttctcaatgtttctgaccagccccggatggagcttgagtaactcaacattaagttctttgatccaactggtacttaccagcgtcaaaccagcctggttgacggctacccgtacccctaaagcattcactaaacgaataacaggttgtaaacgactgatatgttgacctacatcggcctctgcaagttcaataattatgcgttttcgttgtgatttttcacattgcattaacgtatcgcgcagccaacgctgaaaacgcgggcgaatcagcgactcaacggtaacctgaatcgccagattttcctctggccagtaacgcaatagtggaataagacggctgatttgcagacggtcatactcttccgataagccaaactgcaagaccatcggcatatactccgccgagctaacctcttcattaccatcgaagatgcggcacatgagttcgcgatgatgaacctgaccttcgcgagtaaccgccggtttttgataaaggcgcgggccgccgcgactgagcatttgctcgataagcgtacgccagcgaacattaccgcgtcctttttcaggcaacgagtcatcgtaaatagcccagctattgccgccctgcaatcccgcattacgcgtggcagactctgcatgttccattacctgctcggtatcctgaccactacgccaggcgcagataccaatgtggatcatatcgtcgcgatcgagcattttattgttcggcaaggtatcaacggctttgattaactgaccggcgatgctctctgcctcttttaacgtccggtgcggtaacagcgcagcaaaatcactgcggtggtaacgcgccagcagtgcgccagggtagcgcatcataaatgtcgacagcagattcgtcagagtgaagaactgttcttcaacctggctgtgcccccaggtatcgctcaacatattgaaatccggcagacgaatcatcatcacgatcccgtgggtacctactttctcctgatcttccagtaacgttgctaactgattatcgaaaaagagtcggttattgaggccggttttcacgtcctgggcggcataagagcggatcagcgtatcaagacggctgtgttgttcgcgtgcgttctgaatttcacgaagcagcgtatccagcgcactgctggttctgggcggccattcatagatggttcccaacacattagagccacgctcaccgtttaagatacgagtagcccgggtttccagcaattcttgcccggcaagttgccgttgtaaccagcgtaccgccaggaagagcataacaatgataaagccaatcgcccccgtgagcggcgcggtggtcatcaacgaatggaaatagttgcccatcggatcctgataaaccagacgcaacgacatccccggatgctttatcaacggaacgctcagttcgcgaaacagatcgctggagccaactggacgataactaccatttctggccagggtataaacctgtttatcaccatggagcaggtctacacgaacgatatctgccgacatcattaattcggtaatttgtggccttaatacgctgaagtcattcgacacaaggtgggtatcaatcgccgtcgccaccgcctgaacgcgatgactaaacttatactgaatggcgttgtagaaacttagcgaacagcccagcaaagtcacaaaaattgttaacccggtgagcagcgtaacaaaggccgaaaatttcgtcgttaatctcatccttgtgttaactccgatagtgaggaagcgggcatactagcaaatcagatttatctcgcaatttattgcgcttcatcggctttgcttttccattagcgagtatagtcttcagaaattattttccaatccatcatgcacatgaggaccacttatgcaggcgttacttttagaacagcaggacggcaaaactctcgcatcagtacagactctggacgaaagtcgcctgccggagggcgatgtcacggtcgatgttcactggtcgagcctgaactataaagatgcgctggcgattaccggtaagggaaaaatcatccgtaattttccgatgattcctgggatcgattttgccggaactgtacgcaccagcgaagatccgcgttttcatgccggtcaggaggtgttactcactggctggggcgttggtgaaaaccactggggtgggctggcggagcaggcgcgagtgaaaggtgactggctggttgccatgccgcaagggctggacgcgcgtaaagcaatgattatcggtactgccggttttaccgccatgctgtgtgtgatggcgctggaagatgccggtgttcgcccgcaggacggggagattgtcgtgacgggtgccagtggtggcgtcggcagtaccgccgtggcgctgctgcataagttgggttatcaggtcgttgccgtttccggtcgcgaaagtacccatgaatatctgaaaagtttaggtgctagccgtgttctccctcgtgatgagtttgccgaatcccgtcctctggaaaaacaagtctgggctggggcaattgacaccgttggcgacaaagtgctggcaaaagtgctggcgcaaatgaattacggcggctgcgtggcggcctgtggtctggcgggtggttttactctgccaaccacggtcatgccatttattctgcgtaatgtccgtttgcaaggggtggattcagtaatgacgccaccagaacgccgcgcacaagcctggcagcgactggtcgccgatttaccggaatcattctatacccaggcggcaaaagagatatctctggcagaggcaccgaagtttgccgaggccatcattaataaccagatccagggtcgcacgctggtgaaggttaactaaccatttagcaaggaataataagagagggaactcattttgaaatcattattcaatcggttaacgggaaaagcggttagccggacagctttcgtcgaacatcttggtcaggaagttgtacaacatcatccaaactggaaagtcatgatttcgactgaccataaattgatgcgcattgatacgggtcaccaaacggtggaaatcacccttgatgatgcctacaaacgttatcaagccgcaccagacccgctgcaagaagtggctgcagatatgctgaaacagcttgcagaaatgctgccgaccgggcgctgtattgttccggtgattaaagaaaaagcctggctggataccgttcgccaacagcttagccagtatgagtctgatccagaggtcctcaacgcctcgctggattttgcctgggaagactttaacgatgagttaattatcttgtttgctgaagatggtagcgaaaccatgcgctatctgatgcgctacgaagtgaccattgaccgcgaaaaagccatcagtaatttgaagcaaatattgccggaagttacggctgaaatcgttgatacaggcgcaaacgatggaaaagttgccgttatctccgcagggggtacttatgagcccagtctgatgctcattgacgatctttgggtgcaatcacccgatcctgaatgcggcgacctgttagtgaccgttccctccagaggaaaactgtttttcacccacaatgatcagccagcaaatctcagtgcattacgacagttaacagaacaatgcttccgtgaggatgaccatcctctgacaacacagatattcatccgccgtaacggtcacttttatccctgggtagaaaccttgcattaacgcaacctccgtcatgcttgaaaaagcttgtcggagtatgtgatgaaaactgcaaactcaccgaagccgattttgctaccaaatcggcttttttattgtcaggtggcaaattctgaaagcatcagatagccgcactgccgcctgacaaaacagtttaccttctgcaaaatggggggaataatctgattttgtttgactaaaaattaatcactcgaacctatttaatgctgagcattgtcaatcggttaattttgcgtgctttagcattcacatctatccagacgatgcagtgaaaattgggtaatccccagcaaccgctgcgtaatgtcgtctatcttgtcgcgatcctggcatccctacattatttgtggtctgtgaagattatctcattgcagcccctcatcttcgcagggctggctttacagcttttcaccttacgttataagaagttccgtcgatgatggcgctaatttcgtgaattgtgcggcttgttgcaaattacacggtgttgaaggttatttacatgttagctgttgattatcttccctgataagaccagtatttagctgccaattgctacgaaatcgttataatgtgcgacctcgtcctccctgacgcagtttttgcgctgcggaaaaggtgacattggcgcaacgaaggtatattttgttttttgccggaggatagcagcagatcgctgcacaatgtccgtcaagtctaacattgacactctggggcaaaatagaccggcgtcccggcctgctggaatttatcgctatgcatacagctgtcggggcatacgctttacagacggcggtgaaacgcctgtcacaatcacactaaacaaagagtacggaacccactcatggatattcgtaagattaaaaaactgatcgagctggttgaagaatcaggcatctccgaactggaaatttctgaaggcgaagagtcagtacgcattagccgtgcagctcctgccgcaagtttccctgtgatgcaacaagcttacgctgcaccaatgatgcagcagccagctcaatctaacgcagccgctccggcgaccgttccttccatggaagcgccagcagcagcggaaatcagtggtcacatcgtacgttccccgatggttggtactttctaccgcaccccaagcccggacgcaaaagcgttcatcgaagtgggtcagaaagtcaacgtgggcgataccctgtgcatcgttgaagccatgaaaatgatgaaccagatcgaagcggacaaatccggtaccgtgaaagcaattctggtcgaaagtggacaaccggtagaatttgacgagccgctggtcgtcatcgagtaacgaggcgaacatgctggataaaattgttattgccaaccgcggcgagattgcattgcgtattcttcgtgcctgtaaagaactgggcatcaagactgtcgctgtgcactccagcgcggatcgcgatctaaaacacgtattactggcagatgaaacggtctgtattggccctgctccgtcagtaaaaagttatctgaacatcccggcaatcatcagcgccgctgaaatcaccggcgcagtagcaatccatccgggttacggcttcctctccgagaacgccaactttgccgagcaggttgaacgctccggctttatcttcattggcccgaaagcagaaaccattcgcctgatgggcgacaaagtatccgcaatcgcggcgatgaaaaaagcgggcgtcccttgcgtaccgggttctgacggcccgctgggcgacgatatggataaaaaccgtgccattgctaaacgcattggttatccggtgattatcaaagcctccggcggcggcggcggtcgcggtatgcgcgtagtgcgcggcgacgctgaactggcacaatccatctccatgacccgtgcggaagcgaaagctgctttcagcaacgatatggtttacatggagaaatacctggaaaatcctcgccacgtcgagattcaggtactggctgacggtcagggcaacgctatctatctggcggaacgtgactgctccatgcaacgccgccaccagaaagtggtcgaagaagcgccagcaccgggcattaccccggaactgcgtcgctacatcggcgaacgttgcgctaaagcgtgtgttgatatcggctatcgcggtgcaggtactttcgagttcctgttcgaaaacggcgagttctatttcatcgaaatgaacacccgtattcaggtagaacacccggttacagaaatgatcaccggcgttgacctgatcaaagaacagctgcgtatcgctgccggtcaaccgctgtcgatcaagcaagaagaagttcacgttcgcggccatgcggtggaatgtcgtatcaacgccgaagatccgaacaccttcctgccaagtccgggcaaaatcacccgtttccacgcacctggcggttttggcgtacgttgggagtctcatatctacgcgggctacaccgtaccgccgtactatgactcaatgatcggtaagctgatttgctacggtgaaaaccgtgacgtggcgattgcccgcatgaagaatgcgctgcaggagctgatcatcgacggtatcaaaaccaacgttgatctgcagatccgcatcatgaatgacgagaacttccagcatggtggcactaacatccactatctggagaaaaaactcggtcttcaggaaaaataagactgctaaagcgtcaaaaggccggattttccggccttttttattactggggatcgacaacccccataaggtacaatccccgctttcttcacccatcagggacaaaaaatggacactcgttttgttcaggcccataaagaggcgcgctgggcgctggggctgacccttttgtatctggcagtttggttagtagccgcttacttatctggcgttgcccccggttttaccggctttccgcgctggtttgagatggcctgcatcctgacgccgctgctgtttattggactgtgctgggcgatggtgaaatttatctatcgcgatatcccactggaggatgacgatgcagcttgaagtaattctaccgctggtcgcctatctggtggtggtgttcggtatctcggtttatgcgatgcgtaaacggagcaccggcaccttccttaatgagtatttcctcggcagccgctctatgggcggtattgtgctggcgatgacgctcaccgcgacctatatcagtgccagttcgtttatcggcgggccaggagctgcttataaatacgggctgggctgggtattgctggcgatgattcagcttcctgcagtctggctttcactcggtattctcggcaagaagtttgcgattcttgcgcgccgctacaatgcagtgacgctgaacgatatgctgtttgcccgctaccagagtcgtcttctggtgtggctggcgagtttgagtttgctggttgcgttcgttggtgcgatgaccgtgcagtttatcggcggtgcgcgcctgctggaaaccgcggcgggtattccttatgaaaccgggctgctgatttttggtatcagcattgcgttatataccgcctttggtggctttcgcgccagcgtgctgaacgacaccatgcaagggcttgtgatgctgattggcaccgttgtgctgcttattggcgtagtacatgccgctggcggcttaagtaacgcagtacagaccttgcaaaccatcgatccgcaactggttacgccacaaggcgctgacgatattctgtcgcctgcctttatgacgtcgttctgggtactggtgtgttttggcgtgattggcctgccgcatactgcggtgcgctgtatctcttataaagacagcaaagccgtacatcgggggatcatcatcggtacgattgtggtcgcaattctgatgttcggtatgcacctggccggagcgttaggtcgggcggtgatccccgatctcaccgtaccggacctggtgatcccaacgttaatggtaaaagtgctgccaccgtttgctgccgggatcttcctggctgcaccgatggctgcgatcatgtcgacaattaacgcccaactgctgcaaagttccgctacgatcattaaagatctctatctgaatatccgtccggatcaaatgcaaaacgagacgcgtctgaagcggatgtcggcggtaattacgttagttctcggcgcgttgctgctgcttgccgcctggaagccgccagaaatgatcatctggctgaatttgttggccttcggtgggctggaagccgttttcctgtggccgctggtgctgggtctttactgggaacgcgccaacgccaaaggcgcgctaagtgcgatgatcgttggcggcgtgctgtatgccgtactcgcgacgctgaatattcagtacctgggcttccaccctatcgtgccctcgttactactaagtttgctggctttcctggtcggaaaccgtttcggtacatccgtcccgcaagctaccgttttgactactgataaataaagagttttgccatgccttggatccaactgaaactgaacaccaccggcgcgaacgcggaagatcttagcgatgcgctgatggaagcgggtgccgtttctatcacttttcaggatacccacgatacgccagtatttgaaccgctgccgggcgaaacgcgcctgtggggcgacaccgatgtgattggtctgttcgacgctgaaaccgatatgaacgacgtggtggcgattctggaaaaccatccgctgctcggcgcaggcttcgcgcataaaatcgaacaactagaagataaagactgggagcgcgaatggatggataatttccacccgatgcgctttggtgaacgactgtggatctgccctagctggcgtgatgtgccggacgaaaacgccgtcaacgtgatgttagatccagggctggcgtttggtacgggtacccatccaaccacctctctgtgcctgcaatggctcgacagcctcgatttaaccggtaaaacagtcatcgactttggctgtggttccggcattctggcgatcgcggcgctgaaactgggtgcagcaaaagccattggtattgatatcgatccgcaggcgattcaggccagccgcgataacgccgaacgtaatggcgtttctgaccgtctggaactctacttaccgaaagatcagccagaagaaatgaaagccgacgtggtggtcgctaacatccttgcaggcccattacgtgaactggcaccgttaatcagcgtcctgccggtttcaggcggtttgctgggcctttccggtattctggcaagccaggcagagagcgtttgtgaagcttatgccgatagcttcgcactggacccggtcgtggaaaaagaagagtggtgccgtattaccggtcgtaagaattaaccttcgcatcgccgtagggtgacgcggggcgaagtgcgagcaagctcacaaaaggcacgtaaatttgccgattatttacgcaaatttgcgtgccaaaattttcattcataaagaaaaattgagaacttactcaaatttctttgagagtaaattttagtcactattttctaatatgatgatttttatgagtaattatcgcaccacgctcattttaaatgcaattctttgatccatctcagaggattggtcaaagtttggcctttcatctcgtgcaaaaaatgcgtaatatacgccgccttgcagtcacagtatggtcatttcttaactcatgcgcatcggacaatatcagctcagaaatcgcctgatcgcagcgcccatggctggcattacagacagaccttttcggacgttgtgctacgagatgggagccggattgacagtatccgagatgatgtcttctaacccacaggtttgggaaagcgacaaatctcgtttacggatggtgcacattgatgaacccggtattcgcaccgtgcaaattgctggtagcgatccgaaagaaatggcagatgcagcacgtattaacgtggaaagcggtgcccagattattgatatcaatatgggttgcccggctaaaaaagtgaatcgcaagctcgcaggttcagccctcttgcagtacccggatgtcgttaaatcgatccttaccgaggtcgtcaatgcagtggacgttcctgttaccctgaagattcgcaccggctgggcaccggaacaccgtaactgcgaagagattgcccaactggctgaagactgtggcattcaggctctgaccattcatggccgtacacgcgcctgtttgttcaatggagaagctgagtacgacagtattcgggcagttaagcagaaagtttccattccggttatcgcgaatggcgacattactgacccgcttaaagccagagctgtgctcgactatacaggggcggatgccctgatgataggccgcgcagctcagggaagaccctggatctttcgggaaatccagcattatctggacactggggagttgctgcccccgctgcctttggcagaggttaagcgcttgctttgcgcgcacgttcgggaactgcatgacttttatggtccggcaaaagggtaccgaattgcacgtaaacacgtttcctggtatctccaggaacacgctccaaatgaccagtttcggcgcacattcaacgccattgaggatgccagcgaacagctggaggcgttggaggcatacttcgaaaattttgcgtaaacagaaataaagagctgacagaactatgttcgaacaacgcgtaaattctgacgtactgaccgtttctaccgttaactctcaggatcaggtaacccaaaaacccctgcgtgactcggttaaacaggcactgaagaactattttgctcaactgaatggtcaggatgtgaatgacctctatgagctggtactggctgaagtagaacagcccctgttggacatggtgatgcaatacacccgtggtaaccagacccgtgctgcgctgatgatgggcatcaaccgtggtacgctgcgtaaaaaattgaaaaaatacggcatgaactaattcaggttagctaaatgcttgattaaaaaggcgctactcggcatggggaagcgccttttttataggtgtcacaaagggagtgaccatgagaacaggatgtgaaccgacccggtttggtaatgaagctaagaccattattcacggtgatgcccttgccgaacttaaaaagctacctactgaaagcgtcgatctgatctttgccgacccaccgtataacatcggtaaaaattttgatggtctgatcgaagcctggaaagaagatctgtttatcgactggctgtttgaagtgattgcagagtgccaccgcgttctgaaaaagcagggcagcatgtacattatgaacagtacggaaaacatgccctttatcgatctccagtgccgcaagctttttaccatcaaaagtcgcatcgtctggtcatatgacagttctggagtacaggcgaaaaaacactacggctccatgtacgaacccatcctgatgatggtgaaagacgcaaagaactacacattcaacggtgatgctattctggtagaagccaaaaccggatcgcagcgcgcgttgatcgattatcgcaaaaatcctccacagccatacaatcatcaaaaagtaccgggtaacgtctgggattttccgcgcgtgcgttatttaatggatgaatatgagaaccacccgacgcaaaaaccggaagccttactgaaacgcattattctcgcctcttccaacccaggcgatatcgttctcgacccgtttgccggtagctttactaccggtgccgtagccatcgccagcggacgaaaattcattggtattgagatcaacagcgagtacatcaaaatggggcttcgacggctggatgtcgcgtcgcattactccgcggaagaactggcgaaagtgaaaaaaagaaagacgggcaaccggtcaaaacaatgccgggttagcgaagttgaccccgatctcattgcaaagtaaaggaagtgtaagcctggttttcagattattcatttcgtgtatatttcctgccagacttggttaaacatgcacaggctcaggtaatgattcgcaagtattggtggctcgtcgttttcgctgtcttcgtttttctgtttgatactttactgatgcagtggattgaactgctggcaacagaaacagacaaatgccgtaatatgaactcagttaatccactaaaactggttaactgtgacgaactgaattttcaggacagaatgtgaatttacatgacacttaattcattcgtttgatgaattaatttcgttatgttttcatctggcatgaacattcttaatacgttatcgaccagcgcgggtgcttgtttataaagatcataacccgccatattcattaaccagttttgaacaattccgctgaaggcaccatcaataataatcatcacaacatctaaatcgaggttatttgctacacaaccttgttgctgacacgcctgcaatacttcgcggagagtctgcggattaaagcccatcttttcgcgtatcactccctcggccagcatctcatcattaaattcacatttgtgatataagattttcagcaacgcctgctggcggggaattttggcaatatattgcaagccgacaatcaatttttcacgcaattgttgaaacgggtcatgctctaatccagccgtcaagtgttcctggattaactcccgcaatgaaggctgttgcaaccacatctcattaaacagttgggtcttgttctcgaagtgccagtagatagcgccacgcgtaacgttagcggcatcggcaatgtcgttgagcgtcgtcttgcttacgccatgttgcgcaaactgggcgatggcagtttcaatcagttcttgccgggtcttcagagcttcggctttggttctttttgccatgattaattattcaggaaataaatatattcgacacagggtgagaaaatagcgaaggttaatctatcatctaatgtgtatttatacgagagggtaacattgagttgctataaatcgtcaaataaataatatatattatttacctaaaatacattcgccacatgaatatatatttcaatttacgaggttttaattctacctctttcaacccgcgtcaaaataaaacagtagaatattaatctttttttgtgtttatgtgccttgagacgccagtattcataactattccttacatcgacgaatgataatttgtaggatagcaaactgtatttttctttctgcgagttaacgcgttgcctttctgggtaaataacgcgcttttggttttttgaggaatagtaatgacgaaacatgccaggtttttcctcctgccctcctttattctgatctccgcggctttaatcgccggttgtaacgataagggagaagagaaagctcacgtcggtgaaccgcaggttaccgttcatattgtgaaaacggccccgttagaagttaagactgaattaccaggccgcaccaatgcttaccgtatagccgaagttcgcccacaggttagcgggatcgtactgaatcgtaatttcactgaaggcagcgatgtacaagcaggccagtccctgtaccagatcgatcccgcgacctatcaggcaaattatgacagcgcgaaaggcgaactggcgaaaagtgaagccgccgccgccatcgcgcatttgacggtaaaacgttacgttccgctcgtgggtacgaaatacatcagccagcaggagtacgaccaggccattgctgatgctcgccaggccgatgccgccgtgattgccgcaaaagccacagtcgaaagcgctcgcatcaatctcgcttataccaaagtgactgcgccaattagcggacgtatcggcaaatcgaccgtgaccgaaggcgctcttgtcactaatgggcaaacgactgaactggcgactgtccagcagctcgatcctatctacgttgatgtgacccaatccagcaacgattttatgaggctgaagcaatccgtagagcaaggaaatttgcataaggaaaacgccaccagcaacgtagagttggtcatggaaaacggtcaaacctatcccctgaaaggtacgctgcaattctctgatgtgaccgttgatgaaagcaccggctccataaccctacgtgctgtcttccctaacccgcaacatacgcttttgccgggtatgtttgtgcgtgcacggattgatgaaggcgtccaacctgacgccattcttatcccgcaacaaggcgttagccgcacaccgcgtggtgatgcaaccgtgctgattgttaacgataaaagtcaggtggaagcgcgccctgtcgttgccagtcaggcgattggcgataaatggttgattagcgaaggtctgaaatctggcgatcaagtcattgtcagcggcctgcaaaaagcgcgtccgggagagcaggttaaagccactaccgatacccccgcagatactgcatcgaagtaaggtaatctgacatggcaaacttttttattcgacgaccgatatttgcatgggtgctggccattattctgatgatggcgggcgcactggcgatcctacaattgcccgtcgctcagtatccaaccattgcaccgcctgcggtttctgtttcggcaaactatccaggtgctgatgcgcagaccgtgcaggatacggtgacgcaggttatcgaacagaatatgaatggtatcgataacctgatgtatatgtcctccaccagcgattccgccggtagcgtgacaattacccttaccttccagtccgggaccgatcctgatatcgcgcaagtgcaggtgcagaacaaactccagctcgccacgccgttgctgccgcaggaagttcagcagcaggggatcagtgttgaaaagtccagtagcagctatttgatggtggcgggctttgtctctgataacccagacaccacacaggacgatatctcggactatgtggcttctaacgttaaagatacgcttagccgtctgaatggcgtcggtgacgtacagcttttcggcgcacagtatgcgatgcgtatctggctggacgccgatctgctaaacaaatataaactgacaccggttgatgtgattaaccagttgaaggtacagaacgatcagatcgctgccggacagttgggcggaacgccagcgttaccagggcaacagttgaatgcctcgattattgctcagacgcggttaaaaaatccggaagaattcggcaaagtgaccctgcgcgtaaacagtgacggctcggtggtgcgtctgaaagatgtcgcacgggttgaacttggcggtgaaaactataacgttatcgctcgcatcaacggaaaaccggcggcgggcctggggattaagctggcaaccggcgcgaatgctctcgataccgcgaaagccattaaggcaaaactggcggaattacagccattcttcccgcagggaatgaaggttctctacccttatgacaccacgccattcgtccagctttctattcacgaagtggtaaaaacgctgttcgaagccattatgctggtgttcctggtgatgtatctgttcttgcagaatatgcgagcaacgctgatccccaccattgcggtacccgtggtgttgttagggacgtttgccatcctcgccgcttttggttactccatcaacacactaacgatgttcgggatggtgcttgccatcgggctgctcgtcgatgatgcgatagtggtggtggagaacgtcgagcgcgtgatgatggaggataagctcccgccaaaagaagcgacggaaaaatcaatgtcgcaaattcagggcgcactggtgggtatcgcgatggtgctgtcagcggtatttattccgatggcattcttcggcggttctactggggcaatttatcgccagttctctatcaccatcgtttcggcaatggcgctttctgttctggtggcattgattcttacccctgcgttatgtgcaacgctgcttaaacccgtctctgctgagcatcacgaaaataagggcggtttcttcggctggtttaataccaccttcgatcatagcgttaaccactacaccaacagcgtcggcaaaatcctcggttccacaggacgatatttactgatctatgcgctgattgttgcaggaatggtggtgttgtttttacgtcttccgtcttccttcttacctgaagaggatcagggtgtctttctgaccatgattcagttacccgctggcgcgacgcaagagcggacgcaaaaagtgttggatcaagtgacggattactatctgaaaaacgagaaagcgaacgttgaaagtgtctttacggttaacggctttagcttcagcggccaggcacaaaacgccggtatggccttcgtcagtctgaaaccgtgggaagagcgtaatggtgatgaaaacagtgcggaagcggtaatccatcgtgccaaaatggaattgggcaagatccgcgacggttttgtcattccattcaatatgccagccattgttgaactgggcacggcaacgggtttcgactttgagttaattgatcaggctgggctgggtcacgatgccctaacccaggcccgtaaccagttgcttggtatggctgcgcaacatcctgccagcttagtcagcgtgcgtcctaatggcctggaagacaccgcgcagtttaaactggaagttgaccaggaaaaggcgcaggcattaggtgtttcactttctgacatcaatcagaccatttcaacggcgctgggtgggacttacgttaacgacttcatcgaccgtggtcgtgtgaaaaaggtgtatgttcaggcggatgccaaattccgtatgctgccagaagatgtcgataaactttatgtccgcagcgccaacggcgaaatggtgccattctctgcctttaccacttcacattgggtgtatggctctccgcgactggaacgctacaacggtctgccgtcaatggagattcagggggaagccgcgccaggaaccagttccggcgatgccatggcgttgatggaaaaccttgcgtcaaaattacctgcgggcattggttatgactggacgggtatgtcgtatcaggaacgcttatcgggaaaccaggctcccgctctggtagcaatttcctttgtggttgttttcctgtgccttgctgcactctatgaaagctggtcaattcctgtctcggttatgttggtcgtgccgttagggattgtcggcgtgctgctggcggcgacactctttaatcaaaaaaatgacgtctactttatggtgggcttgctaacgacaattggcttgtcggccaaaaacgctattttgattgttgagttcgctaaagatctcatggagaaagagggtaaaggtgttgttgaagcgacactgatggcagtacgtatgcgtctgcgtcctatcctgatgacctctctcgcctttattctcggcgtattaccgctagctatcagtaacggtgccggcagtggcgcgcagaacgcagtgggtatcggggtaatgggaggaatggtctctgcaacgttgctggcaatcttcttcgtaccggtgttctttgtggtgatccgccgttgctttaaaggataaatctgaaacataaaggcgctttcgggtgcctttgttattttcagtgaaacccataaaaattaataagatattcttttgctcactctttaaaagctttctatagttcccgctctcttcactatttttacaattcacataatttgtcattattcattccgcaagatttataacctccggtgataaaatggcattcagctcgttaataagagagttaacttattaaacgttagcgtttattactgaggtaacaccatgaaaagattaattcctgtggcattgctcaccgcattgctggcgggctgtgctcacgattcgccctgcgttccggtttatgacgatcaggggcgtctggttcacaccaatacctgtatgaaaggcacaactcaggataactgggaaacggctggagctattgctggcggagcagcagctgttgctggcctgacgatggggatcatcgctctgtcgaaataactgaacagggcgcgaagtttcgcgctctgtttaacgatacagtatctttacataagataaaatattgctatattctgctggctaattctctgctgatttagcatgttatatcgcgttatttcgctgctttcgaaataacgcatcaatttaactttcacacttctcaccagaaatatactcacgctaacaatcattattctgcttagtaaaacacgcgtaaatattttgcgccaaaatgtggcgcatgtttcattttcgcaccattgcggggcgctgtttttattatttcctgtctacactcagcttattgcgacgcgaaatcgtgcgcaaaagctggcactacttttgcttataagaggatggccacagacaggtaaaagacgtttcccaaacgtcctataacgataattttcgcctcacaggaagcattatgaaaaagatgatgatagccacactggctgccgccagcgtgctgcttgccgttgcaaatcaggcgcatgctggcgcgacgcttgatgccgtacagaaaaaaggttttgtgcaatgcgggatcagtgatggattacctgggttctcttatgccgatgctgacggtaaattttcaggtattgatgttgatatttgtcgtggtgttgccgctgctgtatttggtgacgacacgaaagtgaaatataccccactcacagcaaaagaacgcttcacggctttacagtcaggggaagtggatttgctctcccgtaatacgacctggacttcatctcgcgacgccgggatgggaatggcatttactggcgtcacttattacgacggcattggcttcctgacgcacgataaagcggggctaaaaagcgcgaaagaactggatggcgctaccgtctgtattcaggcgggtactgataccgaactcaacgttgccgactatttcaaggcaaacaatatgaagtacacaccggtgactttcgatcgctctgacgaatcagcgaaggcactggaatctggtcgctgcgatacgctggcctcggatcagtcgcaactgtatgccctgcgcatcaaattaagcaacccagctgaatggattgtcttaccggaggttatctctaaagaaccgcttgggccggtagttcgtcgtggcgatgatgaatggttctcgattgtacgctggacgcttttcgccatgctgaatgctgaagagatgggcatcaattcccagaacgttgatgaaaaagcggctaatccagcaacgcctgatatggcacatctgctgggtaaagaaggcgattacggcaaggatctgaagttggataataaatgggcctataacatcatcaaacaggtgggtaactactcggaaatttttgagcgtaacgtaggttcagaaagcccgctgaaaattaaacgtgggcaaaataatctctggaataacggcggtattcagtacgcaccgcccgtgcgttaagtcggtgtgaggtaacgagcgtcgcgacggcggcgctctcttcagcgttatgctttccgaggtttctatgtctcatcgccgctcaaccgttaaaggctcactctcctttgccaaccctacggttcgtgcctggttattccagatccttgccgttgttgctgttgtcggcattgttggttggttatttcacaacactgtaacgaatctcaataatcgtggcattacttcaggttttgcctttctggatcgcggcgctggcttcggtattgtccagcatttgatcgattaccagcagggcgacacctacggacgcgtttttattgtcggcttactcaatacgctactggtttctgcattgtgtattgtgttcgcttctgttttgggctgctttatcggtctggcgagactttcggataactggctgctacgaaagctttccacaatttatattgagatcttccgtaatattcccccgctgctgcaaatcttcttctggtactttgccgtgttgcgcaatttgcccggaccacgccaggctgtgagcgcgtttgatctggcctttttgagcaatcgtgggctttatattccgtcaccgcagctgggagacggatttattgcgtttatcctggctgttgttatggctatagtcctttctgttgggctattccgctttaataaaacataccagataaagaccggacaactgcgccgcacctggccgatcgccgcagtgttgatcattggtttgcctttactggcgcaatggctttttggcgcagcactacactgggatgtcccagccctacgaggctttaacttccgcggcgggatggttttaattcctgaactggcagccttaacgctggcactttcggtttatacctctgcatttatcgccgagattatccgcgctgggatccaggcagtgccttatggtcaacatgaagcggctcggtcactgggattacccaacccggttacgctacgccaggtcattattccccaggcattgcgggtgattattccaccgttaaccagccagtatctcaacatcgtcaaaaactcctctcttgccgccgctattggctatcccgatatggtttcgctgtttgccggcaccgtgctgaatcagacggggcaagccatcgagacgatagccatgaccatgtcggtctatctgattatcagcctgactatctcgctgctgatgaatatctataaccgccgcatcgcgatcgttgaacgctaaggagtcatgatgacaaaagtattgctgtctcatcccccgcgcccggcgagccataactcaaaccgcgcgatggtgtgggtgcgaaaaaatctgttctccagctggagcaatagcctgctgactattggctgcatatggttgatgtgggaactgatcccaccgttgctgaactgggcatttttgcaggctaactgggttggctcaacgcgtgccgactgcacaaaagccggtgcctgttgggtcttcatccacgaacgatttggtcagtttatgtatgggctttacccacacgaccaacgctggcgaattaacctcgcattactgattgggcttgtgtcgatcgcaccaatgttctggaaaatactcccgcatcgcggtcgctatattgcggcctgggcggtgatttacccactgattgtctggtggctgatgtatggcggtttttttgctcttgagcgggttgaaacccggcaatggggcgggttgacgctaactttaattattgcatcagttgggattgcgggggcgctaccgtgggggatcttactggcgttaggtcgccgctcccatatgccgattgtgcgtatcttatcggtcatttttatcgagttctggcgcggcgtaccgttgattaccgtattgtttatgtcttcggtcatgctgccgttgtttatggcagaaggcaccagtatcgacaaactgatccgcgcgctggttggcgtgatcctgtttcagtcagcatatgttgcggaagtcgtgcgaggcggattacaggcactgcctaaagggcagtatgaagcggcagagtcgctggcgttgggttactggaaaactcagggctggttattctgccacaggcgttgaagctggtaattcctgggctggtaaataccatcatcgcactcttcaaagataccagcctggtgatcattatcgggttgttcgatcttttcagtagcgttcagcaggcaaccgttgatcccgcctggttgggtatgtcgacggaagggtatgttttcgccgcgctgatctactggatcttctgtttcagcatgtcgcgctatagccagcatctggaaaaacgttttaacaccgggcgtacaccgcattgaggacactatgagccaaattttactgcaacctgctaacgcgatgattacgctggaaaacgtcaataaatggtatggacaattccatgttttgaaaaatataaatttaaccgtgcaaccgggagaacggatcgttctgtgtggcccttcaggttccggtaaatcgacaaccattcgttgtattaatcatctggaagaacatcaacagggacggatcgtggtagatggcatcgaacttaatgaagatatccgcaatattgagcgcgtcaggcaggaagtgggaatggtctttcagcatttcaatctcttccctcatctgaccgttctacagaactgtaccctggcaccgatttgggtacgcaagatgcctaagaaagaggctgaagatctggcggtgcattacctcgagcgggtgagaattgccgaacatgcgcataagtttcccggacagatttcaggtggtcagcagcaacgcgttgccattgcgcgttcgctgtgtatgaagccgaaaattatgttgtttgatgagccaacgtcggcgctcgatcctgagatggtgaaagaggtgctggatacgatgattgggctggcgcagtcgggtatgacaatgctgtgtgtaacacatgagatggggtttgcacgaaccgtcgctgaccgggtgatttttatggatcgtggggagatagtggaacaagctgcacctgatgagttttttgcgcatcctaaatcagagcgtacgagggcatttttatcgcaggtaatccattaattgaatgttagttcgaaaagcaaaaaggccatcctttcggatggcctttcgcttgatttgatgtctggcagtttatggcgggcgtcctgcccgccaccctccgggccgttgcttcgcaacgttcaaatccgctcccggcggatttgtcctggttgggagagtgttcaccgacaaacaacagataaaacaaaaggcccagtcttccgactgagccttttgttttatttgatgtctggcagttccctactctcgcatggggagaccccacactaccatcggcgctacggcgtttcacttctgagttcggcatggggtcaggtgggaccaccgcgctactgccgccagacaaattcttttctaatctgccgaactttaacctaaaaagtggtgctgatacccagagtcgaactggggacctcacccttaccaagggtgcgctctaccaactgagccatatcagcacgctaaatttgatgcctggcagttccctactctcgcatggggagaccccacactaccatcggcgctacggcgtttcacttctgagttcggcatggggtcaggtgggaccaccgcgctacggccgccaggcaaattctgttttatcagaccgcttctgcgttctgatttaatctgtatcaggctgaaaatcttctctcatccgccaaaacagcttcggcgttgtaaggttaagcctcacggttcattagtaccggttagctcaacgcatcgctgcgcttacacacccggcctatcaacgtcgtcgtcttcaacgttccttcaggactctcaaggagtcagggagaactcatctcggggcaagtttcgtgcttagatgctttcagcacttatctcttccgcatttagctaccgggcagtgccattggcatgacaacccgaacaccagtgatgcgtccactccggtcctctcgtactaggagcagcccccctcagttctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctggcttatgccattgcactaacctcctgatgtccgaccaggattagccaaccttcgtgctcctccgttactctttaggaggagaccgccccagtcaaactacccaccagacactgtccgcaacccggattacgggtcaacgttagaacatcaaacattaaagggtggtatttcaaggtcggctccatgcagactggcgtccacacttccaagcctcccacctatcctacacatcaaggctcaatgttcagtgtcaagctatagtaaaggttcacggggtctttccgtcttgccgcgggtacactgcatcttcacagcgagttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttcgcttgcgctgaccccatcaattaaccttccggcaccgggcaggcgtcacaccgtatacgtccactttcgtgtttgcacagtgctgtgtttttaataaacagttgcagccagctggtatcttcgactgatttcagctccatccgcgagggacttcacctacatatcagcgtgccttctcccgaagttacggcaccattttgcctagttccttcacccgagttctctcaagcgccttggtattctctacctgaccacctgtgtcggtttggggtacgatttgatgttacctgatgcttagaggcttttcctggaagcagggcatttgttgcttcagcaccgtagtgcctcgtcatcacgtctcagccttagttttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcgcaggcttacagaacgctcccctacccaacaacgcataagcgtcgctgccgcagcttcggtgcatggtttagccccgttacatcttccgcgcaggccgactcgaccagtgagctattacgctttctttaaatgatggctgcttctaagccaacatcctggctgtctgggccttcccacatcgtttcccacttaaccatgactttgggaccttagctggcggtctgggttgtttccctcttcacgacggacgttagcacccgccgtgtgtctcccgtgataacattctccggtattcgcagtttgcatcgggttggtaagtcgggatgacccccttgccgaaacagtgctctacccccggagatgaattcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttcccttcggctcccctattcggttaaccttgctacagaatataagtcgctgacccattatacaaaaggtacgcagtcacacgcctaagcgtgctcccactgcttgtacgtacacggtttcaggttctttttcactcccctcgccggggttcttttcgcctttccctcacggtactggttcactatcggtcagtcaggagtatttagccttggaggatggtccccccatattcagacaggataccacgtgtcccgccctactcatcgagctcacagcatgtgcatttttgtgtacggggctgtcaccctgtatcgcgcgcctttccagacgcttccactaacacacacactgattcaggctctgggctgctccccgttcgctcgccgctactgggggaatctcggttgatttcttttcctcggggtacttagatgtttcagttcccccggttcgcctcattaacctatggattcagttaatgatagtgtgacgaatcacactgggtttccccattcggaaatcgccggttataacggttcatatcaccttaccgacgcttatcgcagattagcacgtccttcatcgcctctgactgccagggcatccaccgtgtacgcttagtcgcttaacctcacaacccgaagatgtttcacttcagagttgcgaaaatttgagagactcacgaacaactttcgttgttcagtgtttcaattttcagcttgatccagatttttaaagagcaaaacttcgcagtgaacctttgcaggtacactctgaagtattttttatttaatcactacagagatggtggagctatgcgggatcgaaccgcagacctcctgcgtgcaaagcaggcgctctcccagctgagctatagccccataacatgtagttaaaacctcttcaaatttgccgtgcaaatttggtaggcctgagtggacttgaaccaccgacctcacccttatcaggggtgcgctctaaccacctgagctacaagcctgtagaggttttactgctcattttcatcagacaatctgtgtgagcactgcaaagtacgcttctttaaggtaaggaggtgatccaaccgcaggttcccctacggttaccttgttacgacttcaccccagtcatgaatcacaaagtggtaagcgccctcccgaaggttaagctacctacttcttttgcaacccactcccatggtgtgacgggcggtgtgtacaaggcccgggaacgtattcaccgtggcattctgatccacgattactagcgattccgacttcatggagtcgagttgcagactccaatccggactacgacgcactttatgaggtccgcttgctctcgcgaggtcgcttctctttgtatgcgccattgtagcacgtgtgtagccctggtcgtaagggccatgatgacttgacgtcatccccaccttcctccagtttatcactggcagtctcctttgagttcccggccggaccgctggcaacaaaggataagggttgcgctcgttgcgggacttaacccaacatttcacaacacgagctgacgacagccatgcagcacctgtctcacggttcccgaaggcacattctcatctctgaaaacttccgtggatgtcaagaccaggtaaggttcttcgcgttgcatcgaattaaaccacatgctccaccgcttgtgcgggcccccgtcaattcatttgagttttaaccttgcggccgtactccccaggcggtcgacttaacgcgttagctccggaagccacgcctcaagggcacaacctccaagtcgacatcgtttacggcgtggactaccagggtatctaatcctgtttgctccccacgctttcgcacctgagcgtcagtcttcgtccagggggccgccttcgccaccggtattcctccagatctctacgcatttcaccgctacacctggaattctacccccctctacgagactcaagcttgccagtatcagatgcagttcccaggttgagcccggggatttcacatctgacttaacaaaccgcctgcgtgcgctttacgcccagtaattccgattaacgcttgcaccctccgtattaccgcggctgctggcacggagttagccggtgcttcttctgcgggtaacgtcaatgagcaaaggtattaactttactcccttcctccccgctgaaagtactttacaacccgaaggccttcttcatacacgcggcatggctgcatcaggcttgcgcccattgtgcaatattccccactgctgcctcccgtaggagtctggaccgtgtctcagttccagtgtggctggtcatcctctcagaccagctagggatcgtcgccttggtgagccgttaccccaccaacaagctaatcccatctgggcacatccgatggcaagaggcccgaaggtccccctctttggtcttgcgacgttatgcggtattagctaccgtttccagtagttatccccctccatcaggcagtttcccagacattactcacccgtccgccactcgtcagcaaagaagcaagcttctttctgttaccgttcgacttgcatgtgttaggcctgccgccagcgttcaatctgagccatgatcaaactcttcaatttaaaagtttgatgctcaaagaattaaacttcgtaatgaattacgtgttcactcttgagacttggtattcatttttcgtcttgcgacgttaagaatccgtatcttcgagtgcccacacagattgtctgataaattgttaaagagcagttgcgacgcggctttcagctcactgtcgcgaggtggcgtatattacgctttcctctttcagagtcaaccctgaatttcaggatttttttctcttcgttgttccgaccatcctgtgaagtgtttcacgttgtcgtctcaacggaggcgcattatagggatcccaattttttgcacaagtatttttttgatctttttttctgtttgttgttttttcaccctttttgctgcaatcgcacacaaaacggtgcttttttgcatactaaaagacttgcacaaggccaataatgcccccaaagtcattagtaaatcatttattgctgaggtaagtatgtctgatgttttacgcccataccgcgatctttttccacaaatcggtcagcgcgtaatgatcgacgatagcagtgtcgtgattggtgacgttcgtctggctgatgatgtggggatctggccgctcgttgtgattcgtggagatgtacattatgtacagatcggagcacgcaccaatatccaggatggcagtatgttgcatgtcactcataaatcctcgtacaacccagatggcaacccattaaccattggcgaagatgtcactgttggtcacaaggtgatgctccacggctgcaccattggcaatcgagttttggttgggatgggctcaattttacttgatggcgcaatagtagaagatgatgtgatgattggtgcgggtagtctggtcccacaaaataaacggctggagagcggatatctgtatctcggtagccccgtcaaacagatccgcccgttaagtgatgaagagaaggctgggttacgctattccgcgaataattacgtgaaatggaaggacgaatatctggatcagggtaaccagacccagccttgatcatcttcactttgttcctgaattaagttttccgcttcttcttccaggtcccagcgatgctgacgaaaactcgctaaccactgttctggcgtatctccagtaaagcgatacgccagactctcgccagagatcgcgcatgtcagttgcataccattcacgagagcgggaaaacatacacattttttattctcgtcccactcttccctgtccggaaactggatggcctgattcacgcggacaattcctcctgcaattgctttataactggttctacgtcaggcagaacaccgtgccagagaagaaaggcatgagccgcctgtgccaccagcattcctaaaccatcagcattacgctttgagcctcgctgctcacaccatgccagaaaaggagtttttcctttctgatagaacatgtcatagcaataaatgcctggatgaatgagcgatgacgggatcgccggaatatcaccactgatgccactggatgttgcattaataatgagatcaaactcatgaccttccagttcgtccatactcaacgcctgaatactgccagtgtgcgcaaacaatttagccaactcttccgcgcgggataccgtccgattagttattgtcaccgcacagtccagggaaaggagtggcagtagtacgccgcgagatgctccaccagcgccgataagcagaatacgtaaaccagggcggataaaagacagacgttccagatcgcttaacaagcctacaccatcggtattgtcacccagcaggcgtccatcttctaaccgcatgagggtattaacagcaccagccaacgctgcccgttcagtaagctcatccgctctggcaaaagcctcttctttaaaaggcaccgtcacattcgcacctttaccaccagcactaaagaaagcgttcagtgtgttgatgaaatcattgatgggtgccaacacgcgcccatagggatgttcaatattcagttgctgagcaaattgctgatgaatgaatggcgatttgctgtgggctatcggattaccaaaaacagcataggtttccattatgttacccctgtcgaaacagttcacccgtcagggcatcgcggatttctgaaggatttaaacgcccccccgtttcaccaggcacaaccgggaacgccgcgccaaattgtgcgcgaacttcgtctactgttcgacaaggtggcaatccactcaagttggcactggtagaaaccagcggtttaccataagcctggcacaaagcaaccaccaacggatggtcggtgactcgtacagcaagcgaatcaaagcggcccgtcaaccagcgcggtgttgtcgcaggcgcgggaaagacaaaggtgacaggacctggccagcgggaaaaaatggtttcacgctgcacgtcagtcaacatggtgtcatcaatatagggtttaagctgctcgtaatttgctgcgattaaaatcagccccttatcaaccggacgctgttttaactccaacagtcgcatcactgctgtttcgctatcaggatcgcacccaacaccgaaaacggcttccgttggataggcgatgacacgttcttcattgagaacatctatcgcagctgcgatagcgtctctttgcaggttattattcacgttattattccgccgaaaccggctttccacattgtttactggcacaaaagtgttttacaccctgcgcggttttcttttcgatgagtagcggataatgacactcagggcattctccagctatgggtttgaagttaatggcaaattgacactccgggtagcgatcacaagagtgaaatgttttgccataacgggagcggcgctggaccagatggcccgtccgacattgggggcatgtaattgctgtttcgtccggtttatcgataagttcggtatgttcgcattcagggtagttaatgcaaccaataaacataccaaagcgtccctggcgtaataccagatttgcgccacatgcagggcaaacctgcccctccagaactttgacgatatgtccatccgctgaagatttcagaggacggacgtagtcacacgccggatactgtgagcatccaagaaacggaccgtgtttcccggatcgaataaccagttcagccccgcactttgggcaggactcattattacgcaccgtgaacagtgctgatttcgccataacaacttatgctgaattaaagaaatgattaatgcaacataccttcattcacttcaaagagtaattcttccatttgctggtacgcattttcgcagcccggaatattgaacaacaccatcaggatcacccatttcagatcatccagttcgaactctgcgttatccagcgcgagcactcgctctatcaccatttcacgagtttcaaggttgagcacctgaatctgctcaaggaaaagcagaaacccacggcagctggcatccagtcgttcacactcttccggtgtataaatacgcatggagagaggatccgaggccagttgcatcggttctgccaacccttcctgataatcagcaagtttttccagccatagcagggcattgtagatatcttctcgctcaaaacctgcgtcggtaagatcctgttcaagtttgtcttgatccacacgcaactcagcttctgtgtgaatataggtttcaaacaaatacattagtacgtcgaacatggcatgccctcctcaatcggacatagccgccgggtacagctgcgatccatcctgctaactccagttcgagtagttgagtaactacctctggcacaggttggccggcacgttcagcgacgacgtcaacaggtgttacctcatctcctacgttagccaggagctcaggaaatggcaatgccacgtcttgctgatctggtgaataaaatgaattttcaggggcgtctggcaaccagtgcaatccaaattgcaagttttccagaatttcttccggttccgtcacaagaatcgcaccttgttttattaaccagtgaggcccttcgcttcccggattccctattggacctggcaaggcaaaaacttctcgcccctgctcaagcgcacaacgtgctgtcaccagcgaaccactacgcaaagccgcttccaccaccagtacacctttacttagaccactgataatgcgatttcttcgtgggaaattgtaagcaaggggtggaacatcgaggggaaattccgagacgagagcgcccccctgttcaagcagactggcagccagtcgggcatgacggcggggatgaatggtattaagtccattccccaatacagcaatgctgacgccatttacctgtaaggctgctttatgcgctacaccatcgattccacgcgccagtccactcgtaattgtcactccacgcgtcgccagagtttcgcaaaataatcgtccccatcgctcgccataccatgaatgcgcccgactccccactacggcaagctgaaatgaatgcagcgcgtgcagttctccttcaacaaacagtgcgccggggtaatctgtcgtcgccagaagttgaggaggataaaattcgctgtccgcaggaattaaatgatggttgggttgctccaaccaacaaagtgagctttcgatactctttcgtggaaatgaaagaaagcgttgtgcctgccgcaatgtaagccctgtttgctgcaatacaaccgcatcaatatgcgactgttttgccacccagtgagcgatacggaccatatcatcgccgtacaagctgctgatactcattaaacgcagccaaatttctgtatcgaccatccttatctccctgccataagcagccttagcaatctttgcgattggtcagtgatgctgtcaatcagagggggatttgtctagaatagaagaaataatctttctaactcctgaacacatctctggagatttatgtcagttttgcaagtgttacatattccggacgagcggcttcgcaaagttgctaaaccggtagaagaagtgaatgcagaaattcagcgtatcgtcgatgatatgttcgagacgatgtacgcagaagaaggtattggcctggcggcaacccaggttgatatccatcaacgtatcattgttattgatgtttcggaaaaccgtgacgaacggctagtgttaatcaatccagagcttttagaaaaaagcggcgaaacaggcattgaagaaggttgcctgtcgatccctgaacaacgtgctttagtgccgcgcgcagagaaagttaaaattcgcgcccttgaccgcgacggtaaaccatttgaactggaagcagacggtctgttagccatctgtattcagcatgagatggatcacctggtcggcaaactgtttatggattatctgtcaccgctgaaacaacaacgtattcgtcagaaagttgaaaaactggatcgtctgaaagcccgggcttaaggataagaactaacgtgtcagaatcactacgtattatttttgcgggtacacctgactttgcagcgcgtcatctcgacgcgctgttgtcttctggtcataacgtcgttggcgtgttcacccagccagaccgaccggcaggacgcggtaaaaaactgatgcccagcccggttaaagttctggctgaggaaaaaggtctgcccgtttttcaacctgtttccctgcgtccacaagaaaaccagcaactggtcgccgaactgcaggctgatgttatggtcgtcgtcgcctatggtttaattctgccgaaagcagtgctggagatgccgcgtcttggctgtatcaacgttcatggttcactgctgccacgctggcgcggtgctgcaccaatccaacgctcactatgggcgggtgatgcagaaactggtgtgaccattatgcaaatggatgtcggtttagacaccggtgatatgctctataagctctcctgcccgattactgcagaagataccagtggtacgctgtacgacaagctggcagagcttggcccacaagggcttatcaccacgttgaaacaactggcagacggcacggcgaaaccagaagttcaggacgaaactcttgtcacttacgccgagaagttgagtaaagaagaagcgcgtattgactggtcactttcggcagcacagcttgaacgctgcattcgcgctttcaatccatggccaatgagctggctggaaattgaaggacagccggttaaagtctggaaagcatcggtcattgatacggcaaccaacgctgcaccaggaacgatccttgaagccaacaaacaaggcattcaggttgcgactggtgatggcatcctgaacctgctctcgttacaacctgcgggtaagaaagcgatgagcgcgcaagacctcctgaactctcgtcgggaatggtttgttccgggcaaccgtctggtctgatagtccactcttctaagcccggtcttgccgggcgtttttatacttatgaaaaaacaacgtaatttacgtagcatggcggcccaggccgttgaacaagtcgtcgagcaagggcaatcattaagcaacattctgccaccgctccagcaaaaagtttccgataaagacaaagcacttcttcaagagttgtgctttggcgtactgcgtacgctttcgcagttagactggctgattaataagttaatggcccgtccgatgaccggcaaacagcggaccgtgcattacctgattatggttggtttgtatcaactgctttatacccgcattccacctcatgctgcgctggctgaaacggttgaaggcgctatcgcaattaagcgtccgcaacttaaagggttgataaacggtgtattacgccagttccagcgtcagcaagaagagttattagccgagtttaatgccagtgatgcacgttatctgcatccttcctggttgctgaagcgtctgcaaaaagcgtatccagagcagtggcaatccatcgtcgaagccaataaccagcgtccgccaatgtggctgcgtattaatcgtacgcatcattcccgcgacagctggcttgcattgctggatgaagcaggaatgaaaggtttcccgcatgcggattaccctgatgctgtacgtctggaaacacctgcacctgttcatgcgctacctggttttgaagacggatgggttaccgttcaggatgcatcagcacaaggttgcatgacctggcttgcgccacaaaacggtgaacacattttggatctttgtgccgcccccggcggtaaaacaacgcatatccttgaggtggcaccagaagcgcaggttgttgcggttgatatcgacgaacagcgcctctctcgggtttacgacaatttaaaacgccttggtatgaaggcgaccgtgaaacaaggtgatggccgttacccttctcaatggtgtggcgagcaacagtttgatcgcattttattagatgcgccttgttcagcaaccggtgtgattcgtcgccatccagatattaaatggttacgtcgcgatcgcgatatcccggaactcgcgcaattgcagtctgaaattctcgacgccatttggccgcatttaaaaaccggtggaactctggtctatgccacctgttcggtgttaccggaagagaatagcctgcagattaaagcctttttgcaacgtaccgctgatgccgaactttgcgaaacaggaacaccagagcaaccgggtaaacaaaatctacctggtgccgaagagggcgacggcttcttttacgctaagctaatcaaaaagtgatgagataacgggtcgcgactgatgaaaattatcattctgggtgccggccaggttggcggcacactggcggaaaacctggttggcgagaacaacgatattactgttgtcgataccaacggtgagcgtctgcggaccttacaggataaatttgacctgcgggtcgtgcaggggcatggctctcatccacgcgtattgcgggaggcaggtgccgacgacgccgatatgctggttgctgtaaccagttcagatgaaaccaatatggttgcctgccaggtagcctactcacttttcaacacccctaatcgcatcgctcgtatccgctcaccagactacgtgcgcgatgccgataagctatttcattcagatgctgtgccgattgatcatctgatcgcaccagagcagttggttatcgataatatttaccgactgattgagtatcccggcgcattgcaggtggtgaacttcgctgagggtaaagtcagcctggctgtggttaaagcctattatggcggcccgctgattggtaatgcactttcgaccatgcgcgaacatatgccacatatcgatactcgtgtggcagcaattttccgccacgatcgccccattcgtccgcaaggttcgaccattgttgaagctggtgatgaagtgttctttattgccgcttcacagcatatccgcgcggtgatgagtgaattacagcgactggaaaaaccgtataagcggatcatgctggttggtggcggtaatatcggtgcagggctggcgcgtcgtctggaaaaagattacagcgttaaactcatcgaacgtaatcagcagcgcgctgccgaactggcggaaaagttacagaatacgatcgtcttttttggtgatgcgtcggatcaagaactactggccgaagaacatatcgatcaagttgatctgtttattgccgtcaccaacgatgacgaggccaatatcatgtccgccatgcttgccaaacgtatgggtgcgaaaaaggtgatggtattgatccagcgtcgcgcttatgtggatctggttcaggggagcgttatcgatattgcgatttcaccacaacaagcaactatttctgcgttgcttagccatgtgcgaaaagcagatattgttggtgtttcctcattgcgccgcggcgtagcagaagctattgaagccgttgctcacggtgatgaaagcacctcacgcgttgtcggcagagtcattgacgaaatcaagctaccgccaggaacgattattggagcggtggtacgtggaaacgacgtgatgattgccaatgacaatctgcgcattgagcaaggcgatcacgtaattatgttcctcacagataaaaagtttattaccgacgtcgaaagactcttccagccaagccctttcttcttgtaattaataaggcgtctaatgacgccttattatttccctttgattatcaaggattaattaaattcattcctggcaggaaaatggcttaacatttgttagacttatggttgtcggcttcatagggagaataacatgagcattattaaagaatttcgcgaatttgcgatgcgcgggaacgtggtggatttggcggtgggtgtcattatcggtgcggcattcgggaagattgtctcttcactggttgccgatatcatcatgcctcctctgggcttattaattggcgggatcgattttaaacagtttgctgtcacgctacgcgatgcgcagggggatatccctgctgttgtgatgcattacggtgtcttcattcaaaacgtctttgattttctgattgtggcctttgccatctttatggcgattaagctaatcaacaaactgaatcggaaaaaagaagaaccagcagccgcacctgcaccaactaaagaagaagtattactgacagaaattcgtgatttgctgaaagagcagaataaccgctcttaacaagcgcctgaaagcagaagaccagtggtaaaaaagtgatttactttcttgccactggcctcccagttcccccgattgccatgttttccttttcgcatgtaactgcctttccccttcttatttttctctacgcgctgtcggaataagggatcatgtagtaatgcttctatcgcattatcctttatctgccctttagtatgctgatatcgactcataaaaactccagttggttatttaacggcgcgagtgtaatcctgccagtgcaaaaaatcaacaaccactcttaacgccactcgccccttgttcaagagcttcaagaatcgaacaataaacactgctatgagcagtcccacaacaggcatcgttaaggcgttgcaaggaacgctgcatactctgcaactcggctatccgtgcttcgacttcctgcaatctttcctgcacaatgccttttgactcctgacaggtatggtgttcaggatcgatgcggatcgacagcaactcgcggatcgactccagactgaaacctagttgtctggcatggcggataaatttcaatcgctggagatcgctttcggtatataggcgaaacccaccttcagtacgcacttcatgctccatcatctgctgtttttcgtaataacgaatcgtgtcgggtgttacttccgccatttttgccagctcaccaatgcgatacatacatactccactagttatcgttgattttgtccaacaacttgtcagcataatcgccgcgtaaaaaatcggtactcaatccagcttgtcgcagcttcaattccagtaatgacaatcgacggctaacctcttgatattgcggatcatcgtgacggatacctttgagaatatccagaagctgaattgcttctctccgttgctcaagttctggcggtaagcaaccggcattcttcagcaagcgataccccgcacgtaattccggtggcacgtgagaatcatcatccagtatcaatggttcgccgctacctgccaggttatcaaactcacctttcgcttgcgcttctgctatatggcgctctgcccactggtcaagtaaccacataaatactccaggggatgaacaaaaagagtacagctattgtagataagtggggatactacgggtataaaaaaacccgccggggcgggtttttttacgttgcttcagattactctgcagcagcttctgctttctctgaacgatcaaccagctcgatgtaagccatcggcgcgttgtcgcctgcacggaagccacacttcagaatacgagtgtaaccaccggcacggctcgcgaaacgcgggcccagttcgttaaacagttttgccacgatctcgttatcacgagtacgggcgaatgccagacgacgattagcaacgctatcagtcttggcaagagtaatcagcggctcaactacgcggcgcagctctttcgctttaggcaaagtcgtcttgatgatttcatgacgaaccagtgaacctgccatattgcggaacatagcctggcgatggctgctgttgcggttcagttgacgaccactcttacgatggcgcatgaccttatccttctcagtaaaaccttaacctgtgatccggttactcgtcagcgatgcttgccggtggccagttttccaggcgcatgcccagagacagtccacgggaagccagcacgtctttaatctcagtaagagattttttaccaaggttaggcgttttaaggagctcaacctcggtacgctgtaccagatcaccgatatagtggatagcttctgctttaaggcagttagcagagcggacagtcaattccagatcgtcaacagggcgcagcaggatcggatcgaactctggtttctcttctttcacttcaggctgacgtacatcacgtaagtcaacgaaagcttccagttgttcagccagaatggttgccgcacgacgaatcgcctcttcaggatcgattgtgccgttggtttccatttcgatgaccagcttgtccaggtcggtacgctgttctacacgcgctgcttcaacattgtaggcaatacgctccacagggctgtagcatgcgtcgaccagcagacggccgattgggcgctcatcttcttccgaatgaattcgggtagaagccggcacataaccacgaccgcgctgaactttgatacgcatgctaatagacgcgttctcatcggtcaggtggcagatcacgtgctgcggcttgacgatttcgacatcaccgtcgtgggtgatatcggctgcagtcacagggccaatgccagatttattcaaggtaagaataacttcatctttgccctgaactctcaccgccagccctttcaggttgagcaggatttccaggatatcttcctgaacgccttctttggtgctgtactcatgtagtacaccatcaatctcaacctcggtcaccgcgcaacccggcatcgatgagagcagaatacggcgcagtgcgttacccagagtatggccaaagccacgctctaaaggctcaagggtcaccttggcgtgcgtcgaactcacttgctcgatatcaaccaggcgcggttttagaaactctgtcacagaaccctgcattgtgtcctctctttggtactaagctttacttggagtaaagctcgacgatcaggtgttcgttaatgtccgcagacagatcagaacgctccggcttacgcttaaacgtaccttccatcttgccagcatcaacttccagccaggttggcttttcacgctgctcagccagctccagagcggctttcacgcgagactgcttcttcgctttctcacgaatgcttacaacgtcattcggactaacctgataagaagcgatgttaacaacacgaccgtttaccataattgctttatggctaaccagctgacgtgcttctgcacgagtggcaccgaagcccatacggtatacaacgttgtccagacgaccttccagcagagccaacaggttttcaccggtgttgcctttcagacgtgctgcttctttgtagtagttacggaactgacgctccagcacaccatagatacggcgaactttttgcttttcacgcaactgcacaccatagtcagacagacgcggtttacgcgcaccgtgctggccaggagcttgttcaattttacacttggtatcgatcgcgcgaacgccagacttaaggaataagtcggtgccctcacgacggctcagcttgagcttaggacccaaatatcttgccattttctttctccaacaaacctggaaaacgaggcgttatacgcgacgttttttcggcggacgacaaccgttatgagggatcggagtcacatcagtaatgttagtgatgcggaaacctgcggcgttcagagcacgaatagtagattcgcggcctggacccggacctttaaccataacttccagattcttgatgccgtattctttcacggcgtcagcgcaacgctctgctgcaacctgagctgcaaacggagtggatttgcgagaaccacggaaaccggaaccaccggctgttgcccaacccaacgcgttaccctgacgatcagtgatagtcacgatggtgttgttgaaagaagcatggatatgagccacgccgtcagagacttgttttcttacacgtttacgtgcacgaattggtgcctttgccattattcaatcaccccgattatttcttgatcggtttgcgcggacccttacgggtacgtgcgttggtcttggtacgctgaccgcgaaccgggagaccacgacgatgacgcaaaccgcgatagcaaccaagatccatcaggcgcttgatgctcatgctgatttcacggcgcagatcaccttcaacgacaaatttggcaacttcgtcacgcagcgtgtcgatttgtccttcagacagctcactgatcttaacatcttcagcgatacccgctgcagccaggatggctttagaacgggtcttgccgacgccataaatcgaagttaatgcgattacggcatgcttatgatcaggaatgttaatgcctgctatacgggccactatgcactcctactatttaatatgtacgttccatgctgaaaagcccgttttcaggatactcaaatggaaacgcacagacatacaaaagattggctggctaatctagccagctcaacccaactttgcaagaaaaatatgcgaaaaaatcagccttggcgctgtttatgcttcggctcggcactgcaaatcacacggatgacaccatcacgcttaacgattttgcagttacggcataatttcttgacggaagcacgaactttcatttttactctccgtaacttctcgggcgaccaattatcggccgtagcctttcaggttcgccttcttcaatgcagactcatactgactggacatcatcagagtttgcacttgagccataaagtccataatcacgacaacaacgataagcagtgaggtcccaccgaagtagaacggtactttcattgcatcacgcatgaactccgggatcaggcagataaaggtaatatacagcgcaccaaccagggtcaggcgggtcattactttatcgatatacttcgccgtttgctctcccggacgaattcctggtacaaatgcaccggacttcttcaggttatctgctgtttcacgcgggttgaaaaccaacgccgtgtagaagaaacagaagaagatgattgcagacgcatagagtaacacataaagcggttgcccaggctgcaaatacagcgaaattgttgtcagccagttccaaccagtaccgcccccgaaccatgacgcgatggtcgccgggaacagaataatactggaagcgaagattgccgggattacccccgccatattcactttcagcggtaaatgtgtgctctgtgcagcatagacacgacgaccttgctgacgtttcgcatagtttaccacaatgcggcgttgaccacgctcaacaaatacaacaaagaacgtcactgcaaatactaatactgcaaccaacagcaacacgaggaagtgcaggtcgccttgacgcgcttgctcgatagtatgggcaatggctggcgggagtcccgcgacaataccggcgaagataatgattgaaataccgttgccgatacctcgttcagtaatctgttcgcccaaccacatcaggaacatggttcctgtgaccagacttacaacagcggtgaagtagaatgcaaagcccgggttaatcaccaggccttgcataccaggcatattcggcagaccggtagcaataccgatcgactggaatattgccagcaccagagtaccgtagcgggtgtactggctgatcttacgacgaccagactccccttctttcttaatttctgccaacgttgggtgaaccaccgtcagcagctggataatgatcgacgccgaaatatacggcatgatccccagagcaaagatagaagcacggctgagagcaccaccagagaacatgttaaacatctcaatgatggtgcctcgctgttgctcaagcagtttggcaagtacagcggcatcaataccagggatcggaataaaagagccaatacggaacacaatcagcgcaccgataacaaacagcagtctgcgtttcagctcgcctaagccacctttggcactttgaaaatctaatcccggttgtttagccatctgctacttattcctcgattttaccgccagcagcttcgatagcagcacgagcgcctttagtaacacgcaggccacgaacagttaccggagtcgttacttcgccagccaggatcactttcgcgaactcgatctggataccgataatgttagccgctttcagcgtgttcaggtctactacaccgccttctactttagccaggtcagacagacgaatttcggctgtaatcgctgctttacgagaagtgaagccgaatttcggcagacgacggtacagaggcatctgaccaccctcgaaaccgcgacgtacgccaccgccagaacgagacttctgacctttgtgaccacgaccaccggttttaccgaggccagaaccgataccacgacccaggcgtttacccgcctttttggagccttcggccggagacagagtatttaaacgcatctcttactcctcaactttaaccatgaaggaaaccgcgttgatcataccgcgaatagcaggagtatcctcgcgctctacggtgtgaccaatacgacgcagacccaggccaagcagcgttgccttgtgtttcggcagacgaccgattgcactgcgggtttgagtaattttaatagtctttgccatggtttatttccccagaatttcttcaacggatttaccacgcttggcagcgaccatttctggagaattcatattttccaggccatcaatagttgcacgaaccacgttgatcgggttggtggaaccataggctttagccagaacgttatgaaccccagcgacttccagaacggcgcgcattgcaccaccggcgatgataccggtaccttcggaagccggctgcatgaatacgcgagaacccgtgtgaacacctttaacagggtgttgcagagtgccgttattcagcgcgacgttaatcatattgcgacgggctttttccatcgctttctggatcgctgctggaacttcacgcgctttaccgtaaccaaaaccaacgcgaccgttaccatcgccaactacagtcagagctgtgaaggagaaaatacgaccacctttaacggttttagatacgcggtttaccgcgatcagcttttcctgcagttcgccagcttgtttttcgatgtgagccatcttacacctctaccttagaactgaaggccagcttcacgggcagcatctgccagtgcctggacacgaccatgatattggaacccggaacggtcaaaggatacatctttgatgcctttttccagagcgcgttcagcgacagctttacccacagctgcagccgcgtctttgttaccggtgtacttcagttgttcagcgatagctttttctacagtagaagcagctaccagaacttcagaaccgttcggtgcaattacctgtgcgtaaatgtgacgcggggtacgatgtaccaccaggcgagttgcgcccagctcctggagcttgcggcgtgcgcgggtcgcacgacggatacgagcagatttcttatccatagtgttaccttacttcttcttagcctctttggtacgcacgacttcgtcggcgtaacgaacacccttgcctttataaggctcaggacgacggtaggcgcgcagatccgctgcaacctggccgatcacctgcttatcagcgcctttcagcacgatttcagtctgagtcggacattcagcagtgatacccgcaggcagctgatggtcaacaggatgagagaaacccagagacaggttaatcacattgcctttaaccgctgcacggtaacctacaccaaccagctgcagcttcttagtgaagccttcggtaacaccgataaccattgagttcagcagggcacgcgcggtaccagcctgtgcccaaccgtctgcgtaaccatcacgcggaccgaaggtcagggtattatctgcatgtttaacttcaacagcatcgttgagagtacgagtcagctcgccgtttttacctttgatcgtaataacctgaccgttgatttttacgtcaacgccggcaggaacaacgaccggtgctttagcaacacgagacattttttcctccgattaggctacgtagcagataatttcgccaccaagaccagcctggcgcgctgcacgatcagtcataacacctttagaggtagaaacaactgcgatacccagacccgccataactttcggcagctcatctttacgtttatagatgcgcagacctgggcggctgacacgctgaatgctttctacaacagctttgccctggaaatacttcagagtaagttccagttcaggcttggtgtcgccttcaactttaaaatcttcaataaaaccttcttccttcagcacgttggcgattgccactttcagcttggaggaaggcatggtgaccgcagctttgttcgcggcctgaccgttacggatacgggtcagcatatccgcgatcggatcttgcatgctcatctgtctttactcccgtgattcaattggtgacaattaccagctagcctttttcagacccgggatttcaccgcgcatagcggcttcacggaccttaatacggctcaacccgaacttccgcaggaaaccatgcggacgacctgtttgacggcagcggttacgctgacgagacgggctggaatcacgcggcagagtctgcagcttgagaacagcgttccaacgatcttcgtcggaagcgttcacatcagagatgatcgctttcagttcagcgcgtttcgcgaagtatttatcagctaaagctacgcgttttacttcgcgtgctttcattgattgcttagccatttagtaaccctaccttacttgcggaacgggaagtcaaaggcagccagcagagcgcggccttcttcgtcagatttcgcagtagtggtaatggtaatatccaaaccacgaacgcggtcgactttatcgtagtcgatttctgggaagatgatctgctcacggacacccatgctgtagttaccacgaccgtcgaaagacttagcggacaggccacggaagtcacggatacgaggtacagcaatagtgatcaggcgctcaaagaactcccacatgcgttcgccacgcagagttactttacagccgatcggatagccctgacggattttgaagcctgcaacagatttgcgtgctttggtgatcagcggtttttgaccggagattgctgccaggtctgctgctgcgttatccagcagttttttgtcagcgatcgcttcaccaacacccatgttcagggtgatcttctcgacccgagggacttgcatgacagaattgtagttaaactcagtcatgagttttttaactacttcgtctttgtagtaatcatgcagtttcgccatcgtactactccaaattacttgatagtttcgctgttagacttgaagaaacggacttttttaccgtcttcgaatctaaagcctacacggtcagccttgccggttgccgcattgaagattgctacgttggaaacctgaatagcggcttctttttcaacgatgccacccggttggttcagggccggaaccggcttctgatgtttcttaaccaggttgataccttcaacaatgaccttgccggaagacaggacattcttaactttaccgcgtttacctttatctttaccggttaacacgataacttcgtcatcacgacggattttcgctgccatgattcgctccttagagtacttctggtgccagagagataattttcatgaacttctcactacgaagctcacgagttaccggcccaaaaatacgcgtaccgataggctgctcgctgttgttgttcagaagaacacaagcattaccatcgaagcgaatgacagaaccgtccgggcgacgaacacccttcttggtgcgcaccactaccgccttcagcacatcaccttttttgaccttaccacgcggaattgcttctttgatggtgatcttgatgatgtcgcctacgcctgcgtagcgacggtgcgagccacccagaaccttgatacacattacgcgacgtgcaccggagttgtcggcgacgttcagcatagtctgttcttggatcattttagtgctccgctaatgtcaactactactgagacccgaaaatcaggtcgttaaaaatccccatatcgagggcgcggcattataacaccgcttcaaggatatgggtagaaaaaataaacggctcatttctgagccgtttattcgtattgagagagtgtactgtattacagaaccgctttctctacaacgcgaaccagcgtccaggatttagtcttggacagcggacggcattcgcggatttcaaccacgtcaccgataccgcattcgttgttctcgtcatgtacgtgcagtttggtcgtacgcttgatgaatttaccgtagatcgggtgtttcacaaaacgttcgatagcaacaacaatggatttctccattttgtcgctaacaacgcgaccttgcagagtacggattttatcggtcattacgcacccgccttctcgttcagtaaagtcttaacgcgtgcgacatcgcgacgcacttgcttcaacaggtgagactgttgcagctggccacttgcagcctgcatacgcaggttgaactgctcacgcagcaggttcagcagctcggtgttcagctcttcaacgctcttctcacgcagctcttttgctttcattacatcaccgtcttagttacaaaggtggttttaatcggcagtttcgctgctgccagcttgaatgcttcacgggccagctcttccggaacaccgtccatttcatacaggactttacccggctgaatcaaggcaacccaatactccacgttacctttacctttacccatacgcactgccagcggcttttcagtgatcggtttgtccgggaacacacggatccagatcttaccttgacgcttaactgcacgggtcatagcacgacgtgctgcttcgatctgacgggcagtcagacgaccacggccaacagctttcagaccgaagctgccgaagctaacatccgtaccctgcgccagaccgcggttacggcctttgtgcattttacggaattttgtacgctttggttgtaacatcagcgacgctccttatttacggcctttacgctgctgctttttaggctgagcagccggtttttccggttgttcaacagcagccataccacccaggatctcgcctttgaagatccacactttaacgccgattacaccgtaagtggtgtgcgcttcagaggtgttgtagtcgatgtcagcacgcagagtgtgcagcggtacgcgaccttcgcggtaccattcggtacgtgcgatttccgcgccgcccagacggccgctaacttcaactttaatacctttagcgcccagacgcattgcgttctgtacagcacgcttcatagcacgacggaacataacgcgacgttccagctgagaagtgatgctgtcagcaaccagttttgcgtccagttcaggcttacgaacttcggcgatgttgatctgtgcaggaacgccagcgatgtccgctacgaccttacgcagtttttctacgtcttcaccttttttaccgataacaatacccgggcgagcagtgtgaatggttacacggatgctcttagccggacgctcgataacgatacgagatacggacgctttagccagttccttagtcaggtactgacgtactttaaaatcgctgtccaggttgtcagcgaattctttggtgttcgcaaaccaggtagagttccatggttttacaatacccaggcgaataccattaggatgtactttctgacccattgctagtctccagagtctcagcgatcggacacaaccacagtgatgtggctggtgcgcttcaggatgcgatctgcacgaccttttgcacgcggcataatgcgcttcatgctcgggccttcgtctacgaaaattttcgtaactttcagatcgtcaatgtcagcgccatcgttgtgttcagcgttagcaatggcagattccagaactttcttgaccagtacagccgctttcttgttggtgtaggtcaaaatatccagagcctgcgacactttcttaccgcgaatcaggtcagcaacaaggcgaaccttctgagcagaagaacgagcatggcgatgtttagcgatagtttccatctcttcctcctaccttatttcttcttcgcttttttatcagcagcgtggccgcgataagtacgagtcggtgcgaattcacccagtttgtgaccaaccatttcgtcggttacaaataccggaacgtgctgacgaccattatggacagcgatggtcaaaccgatcatgttaggaaagatcgttgaacgacgggaccaagtgcgcaggggcttcttgtctccgctttccaccgctttctctaccttcttcagcaagtgcaggtcaataaaaggacctttcttgagagaacgtggcatggcttatcctctaaaattatttgctacggcgacgtacgatgaatttatcagtacgcttgttgctgcgggtcttcttacctttggtctgaacgccccacggagttaccgggtgcttaccaaagttacgaccttcaccaccaccatgtgggtggtctaccgggttcatcgcggtaccgcgaacggtcggacgaacaccacgccagcgtgcagcacctgctttacccagaacgcgcagcatatgctcagcattgccaacttcgcccagagttgcacggcagtctgcttctactttacgcatttcaccagaacgcagacgcagggtgacataagcaccatcacgagcaacgatctgaacgtaagtaccagcggaacgtgccagctgaccgcctttacctggtttcatttctacgttatgaacagtagaaccaaccgggatgttgcgcatcggcagggtgttacctggtttgattgcagcatcaacgccagactgaatctggtcgccagctttcaggcctttaggggccaggatgtaacggcgttcaccgtctttgtacagaaccagcgcgatgttcgcggaacggttcggatcgtactcaagacgttcaacaactgccgggataccgtctttgttgcgtttgaagtcaacaatacggtaagcctgcttgtggccaccaccgatatgacgagtggtgatacggccattgttgttacgaccaccggatttgctgtttttttccagcaacggagcaaaaggtttgcccttgtgcagctcagggttaaccactttaactacgtggcgacgacccggagatgtcggtttacatttaacaactgccattgtattactcctccgacttactcagcgccgccaacgaagtccagattctggccttctttcagggtgacgtaagcttttttccagtcgctacgacgaccgatacgctgtccgtgacgtttaactttccctttaactaccagggtgttaacgacttcgacttcgacttcaaacagtttctgcacagcagctttgatttctgctttggtcgcgtctttagcaactttgagtacgatggtgttggatttttccatcgcagtagacgctttttcagaaacgtgcggtgcacgcagcaccttcagcagacgttcttcacgaatcatgccagcatctcctcaacttgcttaacagcatcagcagtcattacgactttgtcgaaggcgatcaggctaaccgggtcgataccagttgcatcgcgtacgtcaaccttgtgcaggttgcgcgcagccaggaacaggttttcgtccagctcaccggtgatgatcagcacatcttccagagccatgtctttcagtttctgtgccagcagcttagttttcggcgcttctacagagaacttctcgacaacgatcagacgatcctgacgtaccagttcggacaggatgcttttcagcgcgccgcggtacatcttcttgttaactttttgactgtggtcctgcggacgagcagcaaaggtcacgccaccagaacgccagatcgggctcttgatagaaccagaacgcgcacggccggtgcctttctggcgccacggttttttaccggaaccagttacttcagcacgagtcttctgagcacgagtaccctgacgagcaccagctgcataagcaacaacaacctggtgaaccagcgcttcgttgaaatcacgaccgaaggtagtttcggaaacagtcagcgcgctctgcgcgtctttcaatactaattccattgctatctccttacgccttcacagctggtttaacgatcaggtcgctaccggttgcacccgggacagcacctttaaccagcagcaggttgcgctcagcgtcaacgcgtactacgtcaaggctctgaacggttacacgttcgttacccatctgacctgccattttcttgcctttgaacactttgcccggagtctggttctgaccgatagaacccggaacgcggtgagacaaggagttaccgtgagtagcgtcctgggtacggaagttccagcgcttaacggtacctgcgaaacctttacctttagaggtgccagttacgtcaacttttttaacgtcagcaaacagttcaacgctaatgctctgacctacagtgaactcttcgccttcagccaggcggaattcccacagaccacggccagcttctacgccagctttagcgaagtggccagcttcaggcttggtcacacggttagcttttttagcaccggtggtcacctgaatagcacggtagccatcgttagccaggtctttaacctgagtaacgcggtttgcttcaacttcgattacggttactgggatagaaacgccgtcttctgtgaagatacgggtcatacccacttttttaccgactaaaccaatcattgtttcaacctctcaatcgctcaatgacctgattaacccaggctgatctgcacgtctacaccggcagccagatccagacgcatcagagcatcaacggttttctcggttggctcaacgatgtcaaccagacgcaagtgagtacggatttcgtactgatcgcgcgcgtctttgttgacgtgcggggagatcagaacagtgaagcgctctttgcgtgtcggcagcgggatcggaccacggacctgcgcaccagtgcgcttggcagtctcgacgatttccgcggttgcttgatcgatcagacgatgatcaaacgctttcaggcggatacggattctttggttctgcatgagaccagagctccaattattttataaacgaaaatgattactcctcagacccattacgattgatgggagagtgtaaccgttcttacgtagctccccgattgggagcattgttaggtagccaaattcggctaactgaggttcagattgaacctgctgtcaactacgacaagcccgcgcattatacatacttaaccaccgaacgcaagcgtattgctagtaaagtaaacagccttcgggttatctctcaagttcgttcagtgcatttttgacacgctctcttaaaccggctttctcgtcgctttcttccacagtattttcttcgtcttcagaagaagagggggcattctcaaccgcgacgcctgggtcatcttcctcctcgacggattcgacgacggggagtggctgttttttgaagaaatagtgttgtgttgattgtttaaaagcgggcgtttcagcctctacagtgacttcggcttttactatccaaagcacccatagctgcctggcatacccaccaaccagcaccattcctgcaaaccacaggcaaatcagtaataaacaaattacatatattatggtgctgtgtttttgtcgggagaagataccagggtgacctgtttctttctgctcacgcgcggcgatatagaattcaaacatgtcatttccccttcactgttgtttccggggaaatatttgcttcatcccgatataagtaggcactctcccctgccacctgccagagatgtactaacgttgaaaagccaacaacaccgtcagttttcaagtggtggcttttttgaaattgctttattttttctaccaacaagggacgccactccgccgaaggttctgtcgaaatatgcaatgcgcggtttaacatcgtttccagccagagaatctcttcctcgctgctatcacgcgtaatggtactctccccttccggcgacattttccacaacagaagataatcacccgtccataccgactcaaaccatttatgtgtcagcgtccacgtttgctgacctacgaggacatcaacgctagcctcaccgacgcgaacgaccacaacaggcaattttttgtccccgactttaagcgatgcgatccagggcaaattctgatctaccaatgtttgtaaagaagcattcccacttttacatgccagccccgctcttactgcctgatcgcaccaggccgaatcagctgggacctcgtacccccatacgccgtataacacgcttagcgcctcactatcgcgcatcaccacatgagcaatatccttagtcatatcttgtttaactactggcgttacgggtatcagccacgcaggaacgggtaacgtagctgtaaaagaggacagcagtagccaaccacaggtaagagcgataatggttccactcatcaccacggcaagctgcattttccgggggcggttatcacccaatatgcggtaaatcattcgccattgttttgctgtgaaaacgctggtctgctcggcttgctgtaataagcgaattgtttcgccggcaagccccatctttctgcgatcgccccgacataataaagctatccgtttcagaactctggcggttaaaaggagatcgggttggtcaatattctgaccttcaaggatgcttgccttaagttcgtgctccgtcagacgtcctatcgagacaagttcaatgccctgttttttaaaatcacgttcgacttttcgatcgggtctgccgatcagcaaaaattgaccgtcaggaataagagatattgcgcgttggagatcatcaagtatgcggcggtgattcaggtgagcattttcaataataataagagggcagcgactatcagttcgatgaagcgcatgcagtaattgccccgccatctcatctcgcgtccaggcgctgtcacggcagccctgttcagccgcgttatcgtcggtaacgatccatgcggccttaccttgccaggaaacaacgaggcttaaagtaatcacacggcgatgtttatctttttgcagttgctgcgccagccaggtttttccacttccagcctcacccaacaaatagcatagacgccaggtttgacgtttctcacacaaccaggaaagaataacttctcttctcgtagacatagaacttcctgttttaattattgattatccttaatcataaaaataatgtatgtatttattaattaaatacatattactaatataaataaattttgcttgattcatgcaagcggcattaatactatttatactaacgtcaatatacaacccacccaatctattttattagaacatacatcgtgcccacactacgtttccccttccatctggcgaatcataataaagatgctgccatcaatatattgattatatttataagcatagggtctattatttttaatgtgaattatttccatacaactatagttaaaaatggacagatcattaatcaaccaacaaacgcatttcagtctgatttcagccttgccgctttatggcgtaacgaaaatcatgctggggtaaaagatgcaaatcccgtggcagttaatcaggaaacacctaagctctctatagcgcttaatggcattgtactcacatcgaatgatgagacttcttttgtcttaattaatgaggggagcgaacaaaagcgatactccctcaacgaagcccttgagtcagcgccgggaacgtttattagaaaaataaataaaaccagcgttgtgtttgaaactcacgggcattacgaaaaagtaactctccatccagggctacctgacatcatcaagcagcctgattcagaaagtcaaaatgtactcgctgattatattatcgccacgcctatacgtgatggagaacagatatacgggcttcgattgaaccctcgtaagggcctcaatgcatttaccaccagcttgctacaaccaggggatatcgccctcaggatcaataatctttcgctgacccaccctgatgaggtttcacaggcattaagtttactgctaactcaacaaagtgctcagtttacaattcgtcgcaacggcgtaccccgcttgataaatgtttccgtcggggaacttacaggaatgaatggactgcgtcatgaaaggactcaataaaatcacctgctgcttgctggcagcactactcatgccttgtgcaggacacgctgagaacgaacaatacggcgcgaacttcaataacgccgatatccgccagttcgtggaaatagtgggtcagcatcttggcaaaacgatcctgatcgacccttcggtacagggaaccatttccgtacgcagtaatgatacgtttagccaacaggagtactaccagttctttttaagtattcttgatctttacggttattccgtgatcacgctggacaatggttttctgagagtggttcgctcagctaatgtaaaaacatcgccagggatgattgctgacagttctcgtccaggcgtaggtgatgagttggtcacccgaatcgtaccgcttgagaacgttcctgctcgtgacctggcccccctgctccgccagatgatggatgcgggtagcgtcggtaatgttgtgcattatgaaccctccaacgttcttattctgaccggtcgtgcctccaccattaataaactgattgaagtcataaagcgcgttgatgtcatcggcacagagaagcagcaaattattcatctggaatatgcgtcagcggaagatctcgccgagattcttaatcaattaatcagcgaaagccacggtaaaagccagatgccagccctcctctccgcgaggattgtggcggataagcgaaccaactctcttatcatcagtggaccggaaaaagcacgccagcgcatcacttcattactgaaaagccttgatgtcgaagagagcgaggaaggaaatacccgggtttattacctgaaatatgctaaagccacgaatctggtggaagtgctaaccggtgtttccgaaaagctgaaagatgaaaaagggaatgcgcgtaagccctcctcttctggcgcgatggataacgtcgccattaccgccgatgaacagactaactctctggtcattaccgctgaccagtccgtccaggaaaaactcgccacggtaattgcgcgtctggacattcgccgtgcacaggtgctggttgaggcaatcatcgttgaagttcaggatggaaatggactaaacctcggcgtgcaatgggcgaataaaaacgttggcgcacagcaatttaccaataccggattaccgatttttaacgctgcgcaaggtgtggctgattataaaaagaatggtgggatcaccagcgcgaatcctgcctgggatatgtttagcgcctacaatggcatggccgcaggcttcttcaatggcgactggggagtactgcttaccgcgctggccagtaacaataaaaatgacatcctcgccaccccaagcatcgtaacgctggataataaactcgcgtccttcaacgtggggcaggatgtgccggtgctatccgggtcacagaccacttcaggggataacgtctttaataccgtcgaacgcaaaacggtggggacaaaactcaaagttactccgcaggtcaatgaaggcgacgcggtgttgctcgaaatagagcaggaagtctccagcgttgactcttcctctaactcgacgctcggcccgacgtttaatacccgtactattcaaaacgccgtgctggtcaaaaccggtgaaacggtggtcctgggcggattgctggatgatttttctaaagagcaagtgtcaaaggttcctctgcttggcgatattcctttagtggggcaactcttccgctatacctccaccgagcgcgctaaacgcaacctgatggtatttatccgtccgacgattatccgtgacgatgatgtttatcgctcactgtcaaaagagaaatacacccgttaccttcaggagcaacaacagcggatcgacgggaaatcaaaagcgctggttggctcggaagatttgccggtgctggatgaaaacacgttcaacagtcacgcccctgcgccatcgtcacggtgaggcattcatatgagaattcactcaccgtaccccgccagttgggcgctggcacaacgaattggttatctctattcagagggcgagattatttatctcgccgatacgccattcgagcggttactcgatattcaacgtcaggttggtcagtgccagaccatgaccagtttgtcacaggctgatttcgaagcccggctggaagcggtgttccatcagaataccggtgagtcgcaacagattgcgcaggatatcgatcaatccgtcgatcttctctcgctttcggaagagatgcccgcaaatgaagatctcctgaatgaagattcagcggcaccggttatccgcttgatcaatgcgattttgagtgaggccatcaaagaaaccgcctctgatatccacattgaaacctatgaaaaaacaatgtcgatccgttttcgcatcgacggcgttttgcggacaattttacagccaaacaaaaaactggcggcactgcttatctcccgaattaaggtcatggctcgtcttgatatcgccgaaaaacgtattccacaggatggaagaattagtttgcgtatcgggcgacgtaacatagatgtccgcgtatccacactgccgtccatctatggtgaacgcgccgtactccgcctgctggataaaaacagcctccagctttcattgaacaacctggggatgacggcagcggataagcaggatttagaaaatctcattcagcttccgcacggtattatcctggtgacagggccgacaggctccggtaaaagcaccacgctctacgccatcctttcggcgctgaatactcccggccgcaatattctgacggtagaagatcccgtggaatatgagctggaaggcattgggcaaacgcaggtgaatacccgtgtggatatgtctttcgctcgcggcctgcgcgccatacttcgccaggacccggatgtcgtcatggtgggggaaattcgtgatacagaaaccgcgcagattgcggttcaggcctcgctcaccggccatctggtactctcaacactccacactaacagtgcatcaggcgcagtgacccggctccgcgacatgggcgtcgaatcattcctgctttcgtcttccctggcagggattatcgcgcaacgtctggttcgtcgcctgtgtccgcaatgccgacaattcacgcccgtatcaccccaacaagcgcagatgtttaaatatcatcagctcgcggtgacaacaattggcactcccgtaggctgccctcattgccatcaatccggctatcaggggcgcatggcgatccacgaaatgatggtggtgacgccggaattacgggccgctattcatgaaaatgtggatgaacaagcactggagcgactagtccggcaacaacacaaggccttaatcaaaaatggcctgcaaaaagtgataagcggtgacacctcctgggatgaggttatgcgcgtcgccagtgccacgctggagagcgaagcatgaattatcgctatcgcgccatgacccaggatggtcaaaaattgcaagggatcattgatgctaacgatgaacgtcaggcacgactgcggctgcgtgaagaagggcttttcctgctggatattcgcccccaaaaaagttcgggagtaaaaacacgtcgcccgaggatcagccatagtgaactgacgcttttcacccggcagttggcaaccttaagcgcagcggcattacccctggaagagagccttgccgtaatcggtcaacaaagcagtaataaacgactgggtgacgtgttaaatcaggtacgcagcgccatccttgaagggcatcccctttccgatgcattacagcattttcccacgcttttcgattcgctctatcgtaccctggtaaaagcgggcgaaaagagcgggctgctggccccggtgttggaaaagctggctgattacaatgaaaaccggcagaaaatccgcagcaagctcattcagtcactgatctacccctgtatgctcactacggtggcgattggggtcgtgattattctcctcactgctgtcgtgcccaaaattaccgaacagttcgtgcatatgaagcagcaactgccgctgagtacacgcattcttttaggtctgagcgacacgttgcaacgtaccggcccgacattattagcgacagtgtttattgtcgctgtaggtttctggctctggttaaaacgcggcaataaccgccaccgttttcatgccatgttgctgcgcgttgcgctcatcggcccgctgatttgcgccattaacagcgcacgctatctccgcactttaagtattttgcaatccagcggcgtccctctgctggatgggatgaatttgtccaccgaaagcctcaacaacctcgaaattcgccagcgtctggcaaatgcggcagagaacgttcgccagggtaacagcattcatctttcgctggaacaaaccgcaattttcccgccgatgatgctctacatggtggcctctggcgaaaaaagcgggcagctcggcacattaatggtcagagccgcagataaccaggagacactccaacaaaatcggatcgccttaacgctctccatcttcgagccagcactcattattacgatggcactgatcgtcctgtttattgtcgtgtcggtactccaacctcttcttcaacttaactcaatgattaattaaggaaagcatatgcgcgcaacggataagcaacgcggttttacattactggaaattatggtggtgatcgtcattatcggcgtacttgccagcctggtggttcctaacctaatgggcaataaagaaaaggcggataagcaaaaagccgtcagcgatattgtggcgctggaaaacgcccttgatatgtacaaactcgacaatcatcactatccaaccacaaatcaggggcttgaatccttagtagaagcgccgacactgccaccgctggccgcaaactataacaaggaaggttatatcaagcgtctgcctgccgatccctggggcaatgattatgtcctcgttaatcctggtgaacatggtgcatacgatctgctttcagcagggcccgatggtgaaatgggaaccgaggacgacatcaccaactggggtttgagcaagaagaaaaagtaagtcagcgatgaatcagcaacgcgggtttaccctgctggagatgatgctggtgctggcgctggtcgctatcacggcaagcgtggtgctcttcacatatggccgggaggatgtcgccaacactcgtgcgcgcgaaacagcggcgcggtttaccgctgcacttgaattagccatcgaccgcgccacgctcagtggtcagcctgtcggtatccatttctctgattcagcatggcgcattatggtaccgggcaaaacaccatcagcctggcgctgggttccattacaagaagatgccgcagacgagagccaaaatgactgggatgaagaactctcaattcatcttcagccatttaaacctgatgacagcaaccagccacaggttgtgattctggccgacggacaaatcacgcccttctctttgttgatggctaacgccgggaccggtgagccgctcctgacgttagtctgttcaggctcatggcccctggatcaaacgctcgccagagatacccgcccatgaacaaacaatcagggatgacactgcttgaagtcttactggcgatgagtattttcaccgctgttgctctgactttaatgagcagtatgcaagggcaacgaaatgccatcgagcgaatgcgtaacgagacgctggcattgtggatagcggataaccagcttcagtcacaagattcattcggcgaggaaaacacgtccagttctggcaaagagttaataaatggcgaagagtggaactggcgcagcgatatccactcaagcaaagacggcacgcttctggaacgcaccataacggtgacattacccagcggtcagacaacctcgcttacgcgttatcaaagcatcgataataaatccgggcaggcacaagatgattaatcgccagcagggtttcacattgctggaggtcatggcggcgctggcgattttctcaatgcttagcgtgctggcgtttatgattttttcgcaagcttccgagttgcatcaacgctcacagaaagaaatccagcagttcaatcagctacagcgcaccatcaccattcttgataacgatctcctgcaactggtcgcccggaggaatcggagtacggacaaaatcatggtgttgggtgaagaagctatttttaccacgcaaagtcgcgatccgctggctcctctcagtgaagcacaaaccttactcactgttcactggtatctgcgaaatcatacgctctaccgtgctgttcgtacttctgtggatagcaggaaggatcaacccgcccaggcgatgctggaacatgtcgagagctttcttctggaaagtaacagcggggaaagccaggaacttcctctctcagtcacgttacatctgcagactcagcaatatggggggttacagcgccgttttgcattacctgagcagttagcgagagaagagtcgccagctcagacgcaggccgggaataataaccatgaataatgaacaacgcggcgtcgcgctgctcattgtactcatgttactggcgctcatggctgctctggcagcagacatgacgctcagttttcacagccagcttcagcgaacccgccaggtaaaccatcatctgcaacggcaatatgatattgaactggcggagaaacttgcgcttgccagcctcacccaggacgttaaagataacgacagacagaccacgttgcagcagtactgggcacagccacaacagttgcagctggaagatggcaatacagtgaagtggcagttacgcgatgcccagcactgttttaatctcaatgcgttagcaaaaatctctgacgacccgctggcttcccctgatttccccgcccaggtattcagtgcgctgctgattaacgccggtatcgatcgcggaaacaccgatgagatcgtgcaatcaatcgctgactatattgatgtcgatgactcaccacgctttcacggcgcagaagatagcttttaccaaagccagacgccgccccggcatagtgccaatcagatgctttttctgactggcgaattacgtcagataaaaggcataaccgaaaacatctatcagcggcttatcccgtatgtctgcgttctcccgaccacggaacttagcatcaatcttaatatgctaacggagaacgatattccgctcttcagagcgttattcctcaataacatcacggatgctgacgctcgggtcttattgcaaaaaaggccgagggaaggctggctaaccacggatgcatttctttactgggcgcagcaggatttctccggtgtgaagccactggttgctcaggtgaaaaggcatctctttccctatagccgctattttacgctgagtacggaaagtatcagcgacgaacaatcccagggatggcaaagccatatttttttcaaccgtaaacagcagagcgcccaaatctatcggcgtacgctgcaactctactaatcataaggatcgtgatgcctgaatcgttgatggtcatacgttcttcctcgacgctgcgtaagcattgggaatggatgacgttctccgcagatagcgtatcttcggtacatacgctcacggacgatcttccgctggagtcgctggccgatcagcccggtgccggaaatgttcatcttttgatcccaccagagggccttttatatcgttccctcacgctgcccaacgccaaatacaaactcaccgcacaaacattacaatggctggcagaggagacgttacccgacaacacccaggactggcactggacggttgtcgataaacaaaacgaaagtgtcgaggtgataggcattcagtcggagaaactcagtcgctatcttgagcgtttacatactgccggactcaacgtgacgcgggttttgccagatggctgctatcttccctgggaagtagatagctggactctggttaaccagcaaacaagctggctcattcgcagtaccgcacatgccttcaacgaactggatgaacactggttacagcatcttgctgcccagtttccgcctgagaatatgctttgttatggtgtagtacctcacggcgttgcagcggccaatccacttatccagcatcctgaaataccatcactgagtttgtattctgccgatattgcattccagcgctatgacatgctgcatggtatttttcgtaaacagaaaactgtaagcaaatcgggaaaatggctcgcccgcctggcagtaagctgtctcgttctcgccattctttcttttgttggcagccggagcatcgcgctctggcatacgcttaagattgaagatcaacttcagcaacaacagcaagaaacctggcaacgttatttcccgcagatcaaacgcacccacaactttcatttttactttaagcagcaactcgctcagcaatatcctgaagctgtaccgttgctctatcatttacaaacacttctgctggaacaccctgaactgcagttaatggaggcgaactatagccagaagcaaaagtcgctgaccttaaaaatgagtgctaagagtgaagccaatatcgatcgtttctgtgagttaacacagtcctggcttccgatggaaaaaacagaaaaagatccggtcagtggtgtatggacagtaaggaactcagggaaatgattaaatcatggtgggcagaaaaatccacatcggaaaaacagatcgttgcggcactggcggttctctcgctcggcgttttttgttggcttggggtgataaaaccgatagatacctacattgcagagcatcagtcccacgcgcaaaaaattaagaaggacatcaaatggatgcaggatcaagcgagcacccatggtttactcggtcatcctgcgcttacgcagcccatcaaaaatatccttctcgaggaagcaaaacgtgagaatttggctatcacgctggaaaacggcccggacaatactctgacaattcatcctgtcacagctcccctcgaaaacgtctcccgctggctcactacggcacaggtaacatacggtattgttattgaagaccttcagtttactcttgccggaaacgaagagatcaccctcaggcatttgtccttcagggagcaacaataatgacaatgctactgccgctcttcattctggttggttttattgcaggttattttgttaatgccatcgcctatcacctctcgccgttggaggataaaacggcgttaacgtttcaccaggtattggttcatttcaggcaaaaaaaatatgcctggcatgatacagtgcccctgatactttgtgttgctgctgctatcgcctgcgccctggcacctttcacgcccatcgtgactggcgcactctttctctatttctgtttcgtactcacgctcagtgttattgattttcgcactcagctcctgcccgacaaactcaccttaccgctgctctggcttggcttggtatttaatgcgcagtatggattaattgatttacatgatgcggtttacggcgcggtagcgggctatggggtgctgtggtgtgtttactggggcgtctggttagtttgtcacaaagagggattgggctacggtgatttcaagctactggccgctgcaggcgcatggtgtggctggcaaacgttgccaatgatactgctgattgcctcgctgggtggcattggttacgccatcgtttcacaacttctgcaacgccggactataaccactatcgcattcggcccgtggcttgcgctcggcagcatgataaacctggggtatctggcctggatctcttattaaccgggagggttctccctcccgacacggctcaaccttcttcgcggatctgtgcttgcagataattttgcaggcccatcttctgaatcagatcaagttccgtttccagccagtcgatatggccttcttcatcacgcaaaatttctatcatcatatcgcggctgacgtaatcatgaacgctatcggcataaccaattgcctcacgcaaattcttcgcgccatccagctcaagtgccagatcagaacgcagcatttcctcaacatcttcaccaatgttcagtttgcccaagtcctgtaagtttggaagaccttccagaaaaagaatgcgctcaatataacgatcggcgtgtttcatctcatcaatggattcatgatactccacatcattgagacgtttgagaccccagtttttaaacattcgggcatggagaaagtactgattgattgcgacaagctcatttcccaacagtttgttgagataatttataactttagtatcacctttcattttttgactccttcgcttccactctttgaagcgtagaacggcttacgagtaagtcaaaaaacacactccgtttatgcggactccttaaactccggcagctgcattaattcatcctccatcacttcacgcgcggcccggacacatttaccgcactgattgccgaccggaataaatttttttaattgctggaacgagtgaggggaaaactggcgcacagcctgacgaatttttttatcgctgataccattacaaagacaaacgtacatagagactcccgtatactttcttcaaaaataaatgaaaatagttcttatttcaattacggaaagactcttttttaagcaaagaatagaaatatgaataaaaataatgggctaccaaaagtaacccattgacaaaaaatgcggcgataccggaaggtatcgccaacacatttattgcttagtaaacggcgcgaagatttcgctaaatgcgtacttcggtgcctgttctttagtcaggccgtggaattccggagacaggttagtgccgcccggcaggtcgcgcgcgattgaccagataccaaccataccgagattacgcttctgcgcatcctgcatgaccagacgagcatcagagagatagaacacctcgccctgaacgtcgttcacgccaaccatcggcgtggtacccatcatagcgtcaatttctgcatcgctcttgttgggatggaggcctttcaattgtgaatgcaggttggcaatcgcagacgttgcacacttaccgtgaatgttctggccttcggtatttgcagactgacaaatcgcgttaccgtagtccattgtcatcacgttcacacccgccagctcaacacctttcgctttggcatcgctcaggacattcatcccttccggcgtcaggccagtcggtagaattggcaaggtgtaccagatagcaatatctttgccttctgacttccatttatcctgcactttcttcacagcaaggttacgacgttcaatagatgcctgatccgcaacccaggtgccttcgatatcgaagtccaggactctgaggttcaggttatcaacgatgtcataataatgctgcatcagatcgtctacgttcttacaggaagcagccagcggagcgttgttagcaccaccgatagacagcatcacatcgccgccagcctcacgcagagctttgattttgctgtactgagcgtaattctgcataccataagcggtaccccatgtcggcagacaggtgttcgcatctttactcaccacaaacgccagcgtgaagtggttgacgttatgattcttagccagcgcagccaaatccgggatcgtattcagcgtaaagtcaacatacggtgcataaacgtgtttcggccatgctttcttcggcgtacctacacgttctttggttccggtccagtcaacaaaaacacgccacgggttgctgtcagaaggagaaactttctgcactttactctgagaaatgtagttcacaccgttaaagcgaatcagcgtatcgctggcataaagcgtttctggattaaactgcggcgcattattcagctcttcgttgctatagctctgagccttacctaacggcttccacgggcggctattgctaccggtggcgttttggttcgcaaccagagcagggttgtcactttgcgtccagaacagcgcttcataagcctgcccatcaacaacaacgcgatcacctttcacgtacacagtggatgcggaccatgctttcgccggttcgtatttcttccacgggttatcgccgcccgggacaaagccccatgcgtcttgatcgacagaagttttataatgtgcatcgttataatctacgatgctgtccgcgctgtacgctttgctggcctggaaaccatccgcaacaatgacgccgccgttatcaatttcacaggtagtcgggttaccgtactgactcaattccgcagcggtagctgtacgctcgagacgccatgggttattggagttttcagcgctggtaccccgtgggcaatctttagacccaacccaccaggcgttcttgtaaacattaccattgaaaataacatggtaaatttcgctaccttcctggccgctccacgcttgcaatgagtaatcgttaccgctatccgctggtgttgatggctcgctgttatccggagttggggtcaccggtgtttccggagttggatcaaccggagtcacagcaccgccattattatccggcttaacggaacaggagccagggttaccatactggctgatttctgttgccgttgccgcgcgaacataacgccatgggttactggcatcgttttctttcgcatcgcctgggcaatttgccgcgcctacccaccaggcgttcttataaatgccgccgttatagataacgtaccatgtagaagaaccttcctgacctttccaggctactacagcatagttgtcgtttgacttatcagctggggctggctgaacatcaggagccggtttaacgtccggtgccggtttcacatccggtgcaggctgtggtgctgaagtacaggactgtggattactggtttctgagatttccgttgccgtagcggcacgaacataacgccatgggttgctggcatcattgcctttcgcatcacccggacagttagaagaggctacccaccaggcatttttatataccgcaccattaaagacgacataccaggtctgaccgccctgctgtttattccaggcaactacagaagaattagacggaacagtgccctgtgctggtgtagccgaaccgccattagccggcgtattggatgcaggcgtatttgaatttgaagaagatgagctgccgctcttttcgcaggaaagtgtattgccaaactgactaatttcagcagctgttgcggtacgctttaaacgccacgggttagttgcatcatttgctttcgcttttcccgggcaatttgtagaagaaacccaccaggcattttcataaattttgccatcgaaaataacctgatatttattaccaccttgttggttattccatgcttccattgccaatgctggcagagcggaacacaccagccccataccaatcatagatttagtaaatatatttaatttcattataatcccttgtgacgtaaaaactgcaaaacaaaagtcctacgcaggaattatttacgttttacgagaacccttcaatatgaattaaagtgcggcattaaaaataagaaaaaagcctgacaaatgaagaattttaaaaacagaaacattcatatttaaaatattaaattgaattgatattttaaatatgaataatttattcgttctgacagtacgaattagatatacagccaacaaatgcaaaaagggcgccgaagcgccctttttaattcgaaactaattaacgtgtaattagcccagaactttagcaacaacgcccgcgccaacggtacggccgccttcacggattgcgaaacgcagaccgtcgtccatcgcgatcgggtggatcagggtaacaaccattttgatgttgtcgcccggcattaccatctctacgccttccggcagttcgatggtaccagtcacgtcagtagtacggaagtagaactgcggacggtagcctttgaagaacggagtatgacggccgccttcatctttggacagaatgtacacttcagattcgaacttggtgtgcggcttgatggtgcccggcttagccagtacctgaccacgttcgatttcttcacgtttgataccacgcagcagaacacctacgttctcaccagcacggccttcgtccagcagtttgcggaacatttcaacgccagtacaggtagacttctgagtctctttgataccaacgatttcaacttcttcaccaactttgatgataccgcgttctacacgaccggtaacaacggtaccacgaccggagatggagaatacgtcttcgatcggcagcaggaacggcttgtcaatcgcacgctctggttccggaatgtaagaatccaggaagccagccagttccaggattttcgcttcccactctgcgtcgccttccagcgctttcagagcagaaccacgaacgatcggagtgtcgtcgcccgggaagtcgtactgagacagaagttcacgaacttccatttcaaccagttccagcagctcttcgtcatcaaccatatcgcatttgttcaggaacacgatgatgtacggaacgcctacctgacgacccagcaggatgtgctcacgagtctgcggcatcgggccgtcagtcgcagcaactaccaggatcgcgccgtccatctgagcagcaccggtgatcatgtttttaacatagtcggcgtgccccgggcagtctacgtgtgcgtagtgacgggtcggggtgtcgtattcaacgtgagaagtgttgatggtgataccacgagctttttcttccggcgcgttatcgatctggtcgaatgcacgagcagcaccgccgtaggttttagccagtacggtggtgattgcagcggtcagagtagttttaccgtggtcaacgtggccgatagtaccaacgttaacgtgcggttttgtacgttcaaatttttctttagacacggctatattccttactatagtgctctccccttcaggagagagcacgggactttggtattaacccttaggcttatttaccacgggcttcaattacggcctgagcaacgttactcggcgcttcatcatacttcaggaattccatagtgtatgatgcacgacctttggtcagagaacgcagctgagttgcgtatccgaacatttcagacagcggtacttcagcgtggatcttaacgccagtaacttcagattcctgacctttgagcataccacgacgacggctcaagtcaccgataacgtcaccggtgttctcttccggagtttctacttcaaccttcatgatcggctcaagcagaactggtttcgctttcttaaagccttctttaaaggcgatagaagcagccagtttaaacgccagttcagaggagtcaacgtcatggtaagaaccgaagtgcagacgaatacccatgtctactaccgggtagcctgccagcggacctgctttcagctgttcctggatacctttatcaacggccgggatgtattcgccagggattacaccacctttaatgtcgttgatgaactcgtagcctttcgggtttgaacccggctccagcgggtacatgtcgataacaacatgaccatactgaccacgaccaccagactgtttcgcgtgtttaccttcaacatcggtaactttctggcggatagtttcacggtaagcaacctgcggtttacctacgttcgcttcaacgttgaattcacgcttcatacggtcaacgatgatgtcgaggtgcagttcgcccatacccgcaatgatggtctggttagattcttcgtcagtccatacacggaaagacgggtcttctttagccagacggcccagagccagacccattttttcctggtcagctttggttttcggttcaactgcgatggagattaccggctcagggaattccatacgttccagaatgatcggcgcatccgggtcacacagggtgtcaccagtggttacgtctttcagaccgatagcagcagcgatgtcgcccgcgcgaacttctttgatctcttcacgtttgttagcgtgcatctgaacgatacgaccgaaacgctcacgtgcagctttcacggagttcagtacggtatcaccagagttaaccacaccggagtaaacacggaagaaggtcaggttaccaacaaacgggtcggtagcgattttgaacgccagtgcagagaacggctcgtcatcacttgcgtgacgttcagccggagtgtctttaccgtcgtccaggataccgttgatcgcaggtacgtcaaccggggatggcaggtaatcgattaccgcatccagcatcgcctgaacacctttgttcttgaacgcagaaccacaggttaccaggatgatttcgttgttcagaacgcgctgacgcagagcacctttgatttctgcttcagtcagttcttcaccacccaggtatttttccatcagctcttcagaagcttcagctgcggattcgatcaggttctggtgccattcgttagccagttcaaccatgtctgccgggatatcttcgtattcgaaggttacgccctggtcagcgtcgttccagttgatagctttcattttcaccaggtcaacaacaccggtgaaatgttcttcagcaccaatcgccagctgcagcggaaccgggttcgcgcccagacgggttttgatctggttaacaactttcaggaagttcgcacccatgcggtccattttgttaacgaacgcaatgcgcggaactttatatttgtttgcctgacgccatacggtttcagactgcggctgaacaccaccaactgcgcagtaaaccattaccgcaccatcgagaacacgcatggaacgttctacttcgattgtgaagtcaacgtgccccggggtgtcgatgatgttgatgcgatgcggctcatactgcttagccataccagaccagaatgcagtagtcgcagcggaagtgatggtaataccacgttcctgctcctgctccatccagtccatggttgcagcgccgtcatgaacttcaccgattttatggtttacaccggtgtagaacagaatacgttcggtagtagtggttttaccggcgtcgatgtgcgcactgataccgatgttacggtagcgtgcgatgggtgttgtacgagccatttgtttcctcgtttatcttttaggcgttcaatttaagtagcccaaagcgggctgcttactggaagcgcccgcctggtgactaaaactccgaagggattaccaacggtagtgtgcgaacgccttgttggcttcggccatacggtgaacgtcttcacgtttcttaactgcagtacctttgttttctgcagcatcagaaagttcgttcgccaggcgcagagccatggatttatcaccgcgtttacgagcagcttcaacgatccaacgcattgccagagcattacgacgaaccggacggacttcaactggtacctgataagtagaaccaccaacgcggcgagacttaacttctacagtcgggcgcacgttttcgagagctacttcgaatgcttccagttcagatttaccagagcgctgagccagggtctccagcgcgctgtatacgatagattcagcagtagattttttaccatctaccatcaggatatttacaaatttagccagcagttctgatccgaacttcggatccggcagaattttacgctgaccaatgacgcgacgacgtggcatggaaatactccgttgttaattcaggattgtccaaaactctacgagtttagtttgacatttaagttaaaacgtttggccttacttaacggagaaccattaagccttaggacgcttcacgccatacttggaacgagcctgcttacggtctttaacgccggagcagtcaagcgcaccacgtacggtgtggtaacgaacacccgggaggtctttaacacgaccgccacggatcaggatcacggagtgctcctgcaggttgtgaccttcaccaccgatgtaggaagtcacttcgaaaccgttagtcagacgaacacggcatactttacgcagcgcggagttcggttttttaggagtggtagtatatacacgagtacatacgccacgtttttgcgggcatgcttccagcgcaggcacgttgcttttcgcaactttgcgagcacgtggtttgcgtaccagctggttaactgttgccattaaatagctcctggttttagcttttgcttcgtaaacacgtaataaaacgtcctcacacaatatgaggacgccgaattttagggcgatgccgaaaaggtgtcaagaaatatacaacgatcccgccatcaccaggccatctggctggagtgcttaaccgtaagtctgacgaaatcagtatagtcaatgggaatgatgtcgttcgaaatttgaccagtcaaaccgcgggcaataaggtcttcgttcagggcatagaccttaatgggggcattacgcagactttcaaggtagcggttaccgtcaactgcggcagttacgccatcttgcaataatagcagttcgtctccttcactgagcagacgcagcagcgcagcaaaatccgtcagccagggtgaacgatgtaacgtgtgcagcataaacgcctcaaaacctcaaaataacatcgtagttggcgagttcgcggcgtaaggcatctgcttcgagcggcgtggcttcgacaacaaagggtgtctgcggatctaacccgcgttcgcgcagtgaagccgcacaaacccagcactgttcaatgtcgtacagacccaacaatttaaaagtggcaatgtaatcacgcgccagcactgcatcgggcttttgtcctgacagcagctgaaaaacgccatcagcaataaagaagacggccagatcgtcagttaatgcggaagttgccagtaaagcatctaaaccttcccgaccagcagctgtaccatgaggtgcagtagaaaaaacaaacgcaattcgtttcatcagaactgtaccaccctgtcacaggtcagcgaggcttccgccagcgcgccaagtccgcttaaggtaaatcccggctgaaggtttgacgaagccagccccagccttcctgcttcagtttcatcgacgataccgcggcgtaacgctgccgctacgcagatattcagcgccacaccatgttgcgcattcaactgttgccagccgcgcacaaggtcaaattcgtcacttgccggtgaggtcaattggttagcgttatagaccccttcccgatagaaaaagacgctgcttaactcatgaccttctactatcagcgcctgcgcaaactgaaaagcactactcgcctgttgcgtaccgtatgctggcccggtcaccacgatggcaaaacgcattacttatcttgcccctggaaatcaccgcttttgaactggcggatgtagagatagacagtgtgtttggagatgttcaggcggtcagcaacctggttgatcgcgtctttaatatcgaagatccctttctcgtagagattcagcacaatctgacgatttttggcgttattagaaacattgcgatcggcattcacttcttcgatggtgaactccagcgtttgggtaaccagatcttcaacagaagaggcaaagttgacgcttgaaccgacatccggggtttctggcggcacaaaagtgctcataatctgcgagaagggaacatcaagattcatattgatgcacagcagaccaattacacgctgttcgcggttacgaatcgcgatagtcagggacttcattaatacgccgcttttggcgcgagtaaagtagcatttagaaacgctgctatccgctcccgtcatatcgtgcagcatacgtagcgccaggtcagtaattggcgaaccaatcttccggccggtatgttcaccgttagcaatgcgaatggctgaacattttagatcctgcaaagagtgcaaaacgatttcacagtgggagccaataagcatcgctaacccgtccaccaccgcttcgtaggatttcagaatatcaaaatcggtctggtcgaaaggacgttgatccagtaaatccaactcactggtttcgttggttaaaagcgacctggacatgaaaaaaaacactccttttcaggagcctgtcgttaacttttcagggcaggctcattaatgatgcgggtaactaaattaatacagcggaggttccgctttccagcactaattatatccggcctgtaataaaaaaaccgccgcctggtcaggcggcgattcttaatgcttattttttagcagaatctgcggctttcgcatcagcttccggctttgcatcagccttcggcgctggtttcacatccagcagctctacgtcaaacaccagggtagaattcggtgggatccccggaacacccgctttgccgtaagccagttctggtggaataaccagtttgatcttaccgcctttcttgatgttcttcagaccttctgtccaacccgggataacaccgtccagacggaaagaaagcggttcaccacgggtgtaagagttgtcgaactctttaccgtcgatcagcgtacctttgtagttcactacaacagtatcgctgtctttcggtgcttcgcctttaccggcttctactacctgataaaccagaccagttgaagaggttttcacacctttctctttggcaaatttctcgcggtactctttaccttttgcttcgttatcagccgcgtctttttccatcttcgcctgagcagaagacttcacgcgagcttcgaatgcttgcagagtctgttcgatctcttggtcggagagtttgctcttatcagcaaatgcatcctgaacaccagcgatcagctgatctttatccagtttgatgcccagtttttcttgttcttttagagagttttccatgtaacgacccagcgaggcacccagtgcataagctgatttctgatcgtcatttttgaacgctgctttgctgtcagcagttgtagcaggttttgcagcttcagcagcaaaagtgattggtgcatgcagggcaacggccattgtggtcgccagcagcgttactttaaacagtgatttcatccatatctccaggatcggggcatctcaccccagggttaactattatcagaagggtactataaagcgttgtcgaacaaatctacatacagacacgccctattatcatctattttcagactctttttgtttaaattagtttcgatgaccgcgaaatgagtgctgtctcgggcagcaaagttaagtagaatccgcggcgaccattcgacaaaagaggtgaatcatgcaggatttatcattggaagcacgcctggcagagctggagagccgactggcttttcaggaaatcaccattgaagaactgaacgtcacggtgaccgctcatgaaatggagatggcgaaactgcgcgatcatctgcgtctgctgaccgagaagttaaaagccagccagccgtcgaacatcgcgtcgcaggctgaagaaacgccaccgccacattattgaggcgtaaaaaaagcggggattccccgcttttttgtcactttttcggtattagtggcaaccgcaaccgccgttgcctttaccgccacagcagccttcgccaccgtgttcatgaccgtgatcgtggccatgaccgccgcagcaaccgtcgtggtcgtgatcgtggtgatgatcgtgcgcgccgtgaacgtgaccatgagccagttcttcttcggtcgcttcacgaatcgccacaacctcaacgttgaatttcaggttctgaccggccagcatgtggttaccatcaaccactacgtgatcgtcttcaaccgcagtgatttcaaccggtaccggaccctggtcggtttcagccaggaaacgcatacctacctgcagttcatcaacgcccataaatacgtctttaggaacacgttgcaccaggttttcgtcgtactgaccgtaagcgtcgttcgcgccaacagcgacatcaaatttgtcgccaacttcatgaccttccagcgccgtttccaggccagagatcagggaaccgtgaccatgcaggtagtccagcggcgcactcaccggagactcatcaaccaacacaccgtcttctgtacgtacctgataggccaggctgaccaccaggtcttttgctactttcatgatatctcctgagcatgggaagaatagtggcgcagattgtagcggaattctgcagccgtgtactcactagcttaaaaaaactcggcgcatatcgctagtccggatgaaaaatcccgatcacttgctcatctttgcgaacgtgatcgcgggcttctttgtctgcttctcgcatctgatgtccgcacttaacgcattcaacaatatcaatattattttcgcgccacatcgccattgaatcctgtgcctgacaggccgggcattttgcgcccgcaataaaacgttttcggattgccatctttaccctctactcaaattcatcccagccgtccagctggcgtcgttcttgttgcatttcacgctggaaaatctcttccagttcgcgtcgggcttccctggcgcgagaaatttgtacagtatcggcatgcattgggatgagctctcgcagcatccgcatatccaggcggcgaaaatgcagttgcgcccgctgcgcctgatgcggatgcatgccaagcgtgaccagcgtcttgcgccccagctctaacgcactggagaatgtttcacgggaaaactgcgtcacccctgcctgtaataactcatgcgcttccacacgtccgcgcgctcgcgcaagaatatgcaaatgcggaaagtgctgctggcatatttccaccagcttcatggtgtcttccggttcgttacaggtgatcacgatagactcagcggcctctgcacccgcagaacgtaaaagatcgacctgcgtggcgtcgccgtaataaactttgtagccgtatttacgcatcaggttaacggcgctgatatcccgctccagcacggtaatgcgcattttatttgccatcagcaaacgaccaatcacctgaccaaaacgcccgaagcccacgacaatgacctggggtttatcatcgttgacccacggtttttcgtcttcttcttccggtccgttaaactggcgggatagccatttatccaccagcttcatcagcaacggcgtggtcatcatggaaagcgtcaccgtcaccagcaacagcgccatctggtcgccctggaataagcgttgcgaagaagcggtagaaaagaggacaaaggcaaactcgccgccctgactcaacacgccagcaaactgcatccgctctgagctacgcacgccatacaatcgcgccagcagatacaacacgagaattttcaccgccaccagcacaaccacgcttatcactacccacaacagatgggtataaagcaccccgagattgagcgacatgccgacagagataaagaacaaaccgagcagcaagcctttaaagggatcgatagccgtttccagttcatggcgatattcactttccgccagcagcacgcccgcaataaatgtaccgagcgccatcgacagccccagcgcatccataaacaatgcggaacccaacaccagcagcagcgtcgcggcggtgaacacttcccgcacgccagaagctgcaataaagcggaataccggacgcagtaaatagcgcccaccaatcagcatgccgacaaacgccagcaccttcatgccgatcttcatccagtcgaaatgttcgtctgccgaccccgccaacaacggcactaacgccagtgccgggatcaccgccagatcctgaaacagcagtaccgagaaacctaactggccggattcgctgcgattcatccctttctcacgcatcaattgcaacgccattgcagttgaagacatcgcaaggccaatgccaccgaccaccgccgcctgccaggcgaaatccgtcagcatcaataatcccgccagcaacgccgcgcttaacagcacctgtgccgcgcctacgccaaaaatcgaacgccgcagttgccaaagtttggagggattcaactcaaggccgatgataaacatcaggaataccacgccgagttccgaaaagtggaggatctcatcgacgtcgctaataaaccccagcccccacgggccaattgcaatccctgccagcaaatatcccaacacagcgccaatacccagccgcgatgccagcggcaccgcagccaccgccgcgaagagaaacagcactcctgcgagtaaaaaatcggaaccttccatcagcggcctcctggagacagcggatttgccagccagtcaccgtaggctctggcgtggctcgccagctcctgtgcgctttgccgtctcgcccagtaaataatgatgggacttaaccaatgcatccggcacatgcccgccgccagttcaaaggggcgcagcacatcgctcatcgggtagcgattcagcgcgtcataacggtaagcactttccggctcgccggtggtaatcacgctacgccagtactttcccgccagttggtttcctcccggcccgctggcaaaaccacgacttaatacccggtccagccactctttcagtagcgccgggcagctataggtataaagaggatgctgaaagacaatcacctcgtgctcgcgcagtaatgcctgctcacgggggatatcaataaaaaaatcgggatagtgcgcgtaaaggtcgtgcacggtaacattgctgagctgcgtggccggtttaagcagtacccggtttgccaccgagtcctgagattccggatgggcatacagcagcaaaactttcgctggctgagacatcatccccctcccggtatggtttttgtgtatagtcgctgttttgggctaccattgcgcccggtgcggcagctcgcccatacattacattatcataatgataagttaacatagtctgaacatacggcaccttatgattgttttctcctcgttacaaattcgtcgcggcgtgcgcgtcctgctggataatgccaccgccaccatcaaccctgggcagaaagtcggcctggtgggtaaaaacggctgtggtaaatctaccctgctggcattgctgaaaaatgaaatcagcgccgacggcggcagctacacctttccgggaagctggcaactggcgtgggtgaatcaggaaacgccggcgttaccgcaagcggcgctggaatatgtcattgacggcgaccgtgaatatcgtcaactagaagcgcagctacacgacgccaacgaacgtaacgacgggcacgccattgcgaccattcatggcaagctggatgctattgacgcatggagtattcgctcccgtgctgccagcctgctgcacggcctcggtttcagcaatgaacaactggagcgcccggtaagtgatttctccggtggctggcgtatgcgtcttaaccttgcccaggcgctgatttgccgttcagacttgctgctgctcgacgaaccgactaaccacctcgatctcgatgccgttatctggctggaaaaatggttgaagagctatcagggcacgctgatcctgatctctcacgaccgcgacttcctcgatccgatcgttgataaaattattcatatcgaacaacaaagcatgttcgagtacaccggcaactacagttcgtttgaagtacagcgcgccacccgtctggcgcagcaacaagcgatgtatgaaagccagcaggaacgcgtagcgcatctgcaaagttatatcgaccgtttccgtgccaaagccaccaaagcgaagcaggcccagagccgcattaagatgctcgagcgtatggagctgattgcccccgcgcacgtcgacaacccgttccgctttagcttccgcgcgccggaaagcctgccaaatccgttactgaagatggaaaaagtcagcgcgggctatggcgatcgcattattctcgactcgattaaactgaacctggtgcccggctcgcgcattggtctgttaggccgcaacggcgcgggtaaatcgacattaatcaaactgttagccggtgaacttgcgccagtcagcggtgaaattggtctggcgaaagggatcaagctcggctacttcgcccagcatcaacttgaatacctgcgcgccgacgaatcacctattcaacatctggcacgtttagcgccgcaggagctggaacaaaaactgcgtgactacctcggcggctttggtttccagggcgataaagtaaccgaagaaacgcgccgcttctcaggtggggaaaaagcccgcctggtgctggcattaatcgtctggcagcgtccgaatctgctgctgctcgacgaaccgactaaccaccttgacctcgacatgcgtcaggcactcaccgaagcattaatcgagtttgaaggcgcgctggttgtcgtttcgcacgaccgtcatttgctgcgttccaccactgacgatctctacctggttcacgatcgtaaagtcgaaccgttcgacggcgatctggaagattatcaacagtggttgagcgacgtacaaaagcaggaaaaccaggccgacgaagcgccaaaagagaacgcgaacagcgcccaggcacgtaaagatcagaagcgccgggaagcggagctgcgtgcgcaaacccagccactgcgtaaagagattgcccgtctggaaaaagagatggagaagctgaacgcgcaactggcgcaggcggaagagaaactcggcgacagcgaactgtatgaccagagccgtaaagcggagttgaccgcctgcctgcaacagcaagccagcgccaaatccggcctggaagagtgcgaaatggcgtggctggaagcccaggagcagcttgagcagatgttgctggaaggccaaagcaactgatggcgcagataacgacgaccgatgccaatgaattcagcagcagtgctgaattcacccctatgcgcggctttagcaattgtcatctgcaaaccatgctgccgcgtctgtttcgtcgcaaggtgaaattcaccccgtactggcagcggctggagttgcccgacggcgattttgtcgatctcgcgtggagtgaagccccagcacaggcgcggcataaaccgcgtttagtggtatttcacgggctggaaggcagtctcaatagcccttacgcccacggtctggttgaggcggcgcaaaagcgcggctggctgggcgtggtgatgcattttcgcggatgcagcggtgaaccaaaccgtatgcaccgcatttaccattcgggcgaaaccgaagacgccagttggtttttacgctggctgcaacgcgaatttggtcatgcgccaacggctgccgtcggctattcgctcggcggtaatatgctggcctgtttgctggcaaaggaaggcaatgatctcccggttgatgcggcggtgattgtctctgcgccgtttatgctggaagcctgtagctatcatatggaaaagggcttttcccgcgtttatcagcgttacttgctgaacctgttaaaagccaatgccgcgcgcaagctggcagcctaccccggaacgctgccgattaatctcgcgcagttaaaatcggtacgtcgcatccgtgaatttgacgatctaatcaccgccagaattcacggctacgccgacgctatcgactattatcgtcagtgtagcgccatgccgatgctgaaccggatcgccaaaccgacgctgattattcacgccaaagacgatccgtttatggatcatcaggtgatcccgaaaccggaaagtctccccccgcaggtggagtatcaactgactgaacatggcggtcatgttggctttattggcggtacattacttcatccgcaaatgtggctggagtcacgcattcctgactggttaacaacgtatctggaggcgaaatcatgttgattccgtggcaagacctctcccccgaaacgctggaaaatttaattgaaagctttgtgttacgtgaaggcaccgattatggtgaacatgagcgtacacttgaacagaaagtcgccgacgtcaaacgccagctacagtgcggagaagcggtgctggtatggtcggagctgcacgaaacggtcaatattatgccgcgcagtcagtttcgcgaataacctgcaaccgtcggcggacgagataataatgatagctaagtcatggagttactatgtctgccaaacatccggtcattgcggtaacaggatccagcggcgcggggaccaccaccaccagcctcgcgtttcgtaaaatattcgcgcagttaaatctgcatgcagctgaggtggaaggcgacagttttcaccgttacacccgcccggaaatggacatggcgatccgcaaagcgcgcgacgccgggcggcatatcagctacttcggccccgaagcgaacgacttcggcctgctggaacaaaccttcattgaatacggtcagagcggcaaagggaaatctcgcaaatatctgcatacctacgatgaagccgtaccgtggaatcaggtaccgggaacattcaccccctggcaacctttaccagaacccacagatgtactgttttatgaaggtttacacggcggcgtagtcacgccacagcataacgttgcgcagcatgtggacttactggtcggcgtggtgcctatcgttaaccttgagtggattcaaaaactgatccgcgacaccagcgagcgcgggcactcacgagaagcagtgatggactcagtagtgcgttcaatggaagactatatcaactacatcacaccgcagttttcccgcacccatcttaacttccagcgcgttcccaccgtcgacacttcaaacccgttcgcggcaaaaggtatcccgtcgctggatgaaagctttgtggtgatccattttcgtaatctggaagggatcgatttcccctggctgctggcgatgttgcaaggctcattcatttcccacatcaatacgttagtggtgcccggcggcaaaatgggtctggcaatggaattaattatgctgccgctggtgcaacgattgatggaaggaaagaaaatcgagtaactctgctattacgccggataaaatactatccggcttcacaacgggatagttaaatcacgcgccaaccacttcatacgagtgagtaatattcaccgctttttccagcatcaacgccactgaacaatatttctcggcagagagatcaaccgcacgcgcaaccgctgcgtctttcaggtcgcgaccggtgacgataaaatgcagattaatgtgcgtaaacaggcgtggtgcctcttcgcggcgttcagaggtcaattttacttcacaatcgaccacatcctgacgccctttttgcaggatcgaaaccacatcgatggcactgcaaccacccgccgccatcaacaccatttccatcggacttggtgctttatcgcctgagttgccgtccattaaaatctggtgaccagaggcagattcgcccagaaaagttaacccttcgacccacttcactcgcgcttgcatttttgctactccactgcgtcaattttcctgacagagtacgcgtactaaccaaatcgcgcaacggaaggcgacctgggtcatgctgaagcgagacaccaggagacacaaagcgaaagctatgctaaaacagtcaggatgctacagtaatacattgatgtactgcatgtatgcaaaggacgtcacattaccgtgcagtacagttgatagccccttcccaggtagcgggaagcatatttcggcaatccagagacagcggcgttatctggctctggagaaagcttataacagaggataaccgcgcatggtgcttggcaaaccgcaaacagacccgactctcgaatggttcttgtctcattgccacattcataagtacccatccaagagcacgcttattcaccagggtgaaaaagcggaaacgctgtactacatcgttaaaggctctgtggcagtgctgatcaaagacgaagagggtaaagaaatgatcctctcctatctgaatcagggtgattttattggcgaactgggcctgtttgaagagggccaggaacgtagcgcatgggtacgtgcgaaaaccgcctgtgaagtggctgaaatttcgtacaaaaaatttcgccaattgattcaggtaaacccggacattctgatgcgtctgtctgcacagatggcgcgtcgtctgcaagtcacttcagagaaagtgggcaacctggcgttcctcgacgtgacgggccgcattgcacagactctgctgaatctggcaaaacaaccagacgctatgactcacccggacggtatgcaaatcaaaattacccgtcaggaaatcggtcagattgtcggctgttctcgtgaaaccgtgggacgcattctgaagatgcttgaagatcagaacctgatctccgcacacggtaaaaccatcgtcgtttacggcactcgttaatcccgtcggagaggcgcgttacctggtagcgcgccattttgtttcccccgatgtggcgcagactgatttatcaccccgatatcaactatgcacttcgacaaacgctggtgctatgtttgcccgtggccgttgggttaatgcttggcgaattacgattcggtctgctcttctccctcgttcctgcctgttgcaatattgcgggccttgatacgcctcataaacgttttttcaaacgcttaatcattggtgcgtcgctgtttgccacctgtagcttactgacacagctgctactggcaaaagatgttcccctgccctttttgctgaccggattaacgctggtacttggcgtcactgctgagctggggccattgcacgcaaaattgcttcctgcatcgctgctcgccgccatttttaccctcagtttggcgggatacatgccggtctgggaaccgttgctcatctatgcgttgggcactctctggtacggattgtttaactggttttggttctggatctggcgcgaacaaccgctgcgcgagtcactaagtctgctgtaccgtgaactggcagattattgtgaagccaaatacagcctgcttacccagcacaccgaccctgaaaaagcgctgccgccgctgctggtgcgccagcaaaaagcggtcgatctaattacccagtgctatcagcaaatgcatatgctttccgcgcaaaataatactgactacaagcggatgctgcgtattttccaggaggcgctggatttacaggaacatatttcggtcagtttgcatcagccggaagaggtgcaaaagctggtcgagcgtagccatgcggaagaagttatccgctggaatgcgcaaaccgtcgccgctcgcctgcgcgtgctggctgatgacattctttaccatcgcctgccgacgcgttttacgatggaaaagcaaattggcgcactggaaaaaatcgcccgccagcatccggataatccggttgggcaattctgctattggcacttcagccgcatcgcccgcgtgctgcgcacccaaaaaccgctctatgcgcgtgacttactggccgataaacagcggcgaatgccgttacttccggcgctgaaaagttatctgtcactaaagtctccggcgctacgcaatgccggacgactcagtgtaatgttaagcgttgccagcctgatgggcaccgcgctgcatctgccgaagtcgtactggatcctgatgacggtattgctggtgacgcaaaatggctatggtgcaacccgtctgaggattgtgaatcgctccgtgggaaccgtggtcgggttaatcattgcgggcgtggcgctgcactttaaaattcccgaaggttacaccctgaccttgatgctgattaccacccttgccagctacctgatattgcgcaaaaactacggctgggcgacggtcggttttactattaccgcagtgtataccctgcaactgttgtggctgaacggtgagcagtacatccttccgcgtcttatcgataccattattggttgtttaattgctttcggtggtaccgtctggctgtggccgcagtggcagagcgggttattgcgtaaaaacgcccatgacgctttagaagcctatcaggaagcgattcgcttgattctgagcgaggatccgcaacctacgccactggcctggcagcgaatgcgggtaaatcaggcacataacactctgtataactcattgaatcaggcgatgcaggaaccagcgttcaacagccattatctggcagatatgaaactgtgggtaacgcacagtcagtttattgttgaacatattaatgccatgaccacgctggcgcgggaacaccgggcattgccacctgaactggcacaagagtatttacagtcttgtgaaatcgccattcagcgttgtcagcagcgactggagtatgacgaaccgggtagttctggcgatgccaatatcatggatgcgccggagatgcagccgcacgaaggcgcggcaggtacgctggagcagcatttacagcgggttattggtcatctgaacaccatgcacaccatttcgtcgatggcatggcgtcagcgaccgcatcacgggatttggctgagtcgcaagttgcgggattcgaaggcgtaatgcaggctaaaccatcggataaggcattcacgccgcatccgacatcttttgcctgatgcgtcttatttacgccccaaccaccttcgccaccgcgtgggcgaaacgttgcatcccttcatcgatatccgcatcttccaccaccagcgacggtgcaaaacgcatcacatccggtccggcattcagcaccattacgccagcctctgcgcccgcatacaggaaatcacgcgcctgacctttgtactgtggtttcagctccgcgccaattaacagccccataccgcgaatatcgctaaacacatcgtactgctgatcgatcttctgcaaatggtcaacaaaacgctggcgtttcgcctgaatgccttccagcacttcaggggtattaatgatatcaaacgccgcgcccgctactgcacaggccagaggattaccgccgtaggtggaaccgtgagaaccaggatgaaacgcagaagcaatttccgccgtggtcagcatggcgctaatcgggaagccgccgcctaacgctttcgcagaagtcagaatatccggcgtcacgccgtagtgcatgtaagcaaacaaatcgccagtccgccccatcccgcactgtacttcatcaaacaccaataatgcctgatgttgatcgcacaactcacgcaagccctgcaaaaactctggcgtcgctgccgtcacaccgccctcgccttggatcggctcaaccaccactgcacaggtgtgatcatccatcaccgctttcactgcgtggagatcgttaaagggaacgtggatgatgtctgccggttttgacccaaagccgtcggaatattttggctgcccacccaccgaaacggtaaacagcgagcgaccatgaaaagctttatggaaggcaataattttggttttgaacgggctatgacgcacacaggcgtaatggcgtgccagtttaaaggcggtttcgttagcttccgtgccggagttcataaacaccacgcgttcggcaaacgtcgcctcaatcagtttatgcccaagacgcagcgccggttcattggtgaaaacgttactgatatgccacagagtttcgccctgggtttttaacgcgttcaccagcgcaggatggcaatggcccaacgccgtaactgcaatgccacccgcgaaatcgacatactccttgccttgctgatcccagattcggctgccctgaccttttaccggaataaactctgccggtgcataaatcggcaggatcacttcatcgaaagtcgcgcgtgtaattgctgtttgttcaattgccatctcatgatcaccctgttacgcataaataaatttgaaattataatcacaaaatatgcataaaaaatcactgaatggcaatcagaaatcagcgatgcaggaaattagccagcagttgatgtccttgttcgctaagaatactttctggatggaactgcacaccttccagatcccactggcgatggcgaatccccataatctcgcgggtttcgctccaggccgtcacgtcaaagcacgctggtaatgagtcaggttccaccaccagcgaatggtagcgtgtcacggtaagtggatttgccagcccccgaaatacgccctcaccgttatgtgtaatcggcgaggttttgccgtgcatgacctttgcggcgcgcacaactttaccgccaaatgcctgcgccattgcctgatgaccgaggcagacgccaagaatcggcaagcgcccggcatagtggcgaataacgtcaagggagatcccggcttcatctggcgtacaggggccaggtgagatgacaattttttgtggtttaagggcgtcgatatccgccagcgtcaacgcatcgttgcgcttaaccagcacatccgcccccagttcacaaaagtactggtagaggttccaggtaaaagaatcgtagttatctataagcaggatcatggcggctccggtacgaaagaaccacgctattttactcagattccccggcttcgcttaccactttgctaaatatcatctgcagcgcggtgagatcccccattgccccactctgatttgcctgattccaggcttctttttcgataccctgccagctcagttgatatccggcatgaatcgccagttgctcgaagaagatccgctgtgccagtccgcttcccacacggaagggatgcagcacgttgatttcacaatagtaatgcgccagccgctcgacgaacttcgctttctccaggccaaccagataaccttcttcctccagatcctgcatcagggcattgccctctttttcgatataagcaaagtggcagaacggcgtatcgccctgataaatatcaacttcacgcagttgccccgcccagtcgaaaatatcctgatacagctggcgatggatagtgcgcaaatgcggtaaaccgcgcaccagcggaccaagctcaatggtcgcagcacgcagcgccgtcatttcgtaagcggcctgttccagccgctgctgctggtggatgttcagccggttacgcatgatatcaaggccaggataaagatacggatcgcgcccttcgccgaatttatcgctcatagtgcctcctcagctcttcaaggcgcgctaaagcctctgcggcagtaagagtgactaaaggcatctcgacgccttcaagacggcgactggcctggaaattacgattacgctgaagctcccagagacgggacttttgcttatcggtgagtttcttcacttgatgcctccctgaacgtgtccatttgccacaagtataagcggcaaatccgggttacgccgggagagcagaagcgcgggcaagattgcccgcgcgaaaaatcattacggcaggactttagcggaaaggataactaccggttttgacggcacattctggtacggaccaacgtcatgagtcggcacctgggaaatcttatcggcaacgtccatgcctttcaccactttaccaaataccgcgtaaccgaaatcacgctgaccatggtcaaggaaggcgttatcggcaacgttgataaagaactggctggtggcgctgtctttgtcagcggtacgcgccatcgcgatggtgccacgcgtgttgcgcaggccgttatcggcttcatttttgattggcgggtttggttttttctgctgcatctgctcggtgaaaccgccgccctgaatcataaagccaggaatgacgcggtgaaaggtagtgttgttataaaaaccgctgttcacataatcgacaaagttttgcacagacactggcgctttttgtttatccagctccagttcgatgttaccagctgaggttgtcaacaatacgtgcgggtcccctttcgctgccattgctgcgggagaaagagcagaaagagcgaaaacagcagccatcgccgccagggtcgatttgaacatgagatttccttaacaaacagagcagaaaaaaagcaagtgaagagattctaaatagccttcaagaacaaggccatccctttacctaattttacgtatctgaaatatatgtaacctgacgatcactttttattccgtgatcaaaatcacctcttaaaatgcaatttagcaaccgattgcaataaaacatttaaacagatcacaaaataacctaaaatcgcccgctcgcggcatatcccgctatgccattttatttttgaacgcaggccaatcatgactaacagcaatcgcatcaagctcacatggattagctttctctcctacgcactgactggtgcgttggttattgtcaccgggatggtgatgggaaatatcgccgattatttcaatctgcctgtttccagtatgagtaacaccttcaccttcctcaacgccggcattttaatctctatcttcctcaacgcctggctgatggaaatcgtcccgttgaaaacgcagttacgttttggctttctcctgatggtgctggcggttgccggtttgatgttcagccacagcctggcgctgttctcgacggcgatgttcattctcggggtggtcagcggcattactatgtcgattggtacattcctgataacacaaatgtatgaagggcgtcagcgcggttcccgcctgttatttactgactccttcttcagtatggctgggatgattttcccaatgatcgccgcgtttctactggcgcgcagcattgagtggtactgggtttatgcctgcatcgggctggtgtatgtcgctatttttattctgaccttcggctgtgagttcccggcactgggcaaacatgcgccaaaaacggatgctccggtagagaaagaaaagtgggggatcggcgtactgtttctctctgttgcggcgctgtgctacatcctcggtcagttaggttttatctcctgggtgcctgagtatgccaaaggcctgggcatgagcctgaacgacgcgggcacgctggtgagtaacttctggatgtcatacatggtcggcatgtgggcgttcagctttattcttcgcttctttgatttgcaacgcattctgaccgtactggctggtctggctgcgattctgatgtacgtctttaacaccggaacaccagcacatatggcgtggtcaattctcgctctgggcttcttctccagcgcgatctataccaccatcatcaccctgggttcacagcagaccaaagtaccgtcgccaaaactggttaactttgtcctgacctgcggaaccatcggtactatgttgacctttgtggttaccggcccgattgttgaacatagcggtccgcaggcggcactgcttacagcaaacggtctgtacgctgtcgtctttgtgatgtgcttcctgttaggtttcgtcagccgtcaccgtcagcataacaccctgacctctcattaattgctcatgccggacggcactatcgtcgtccggccttttcctctcttacccccgctacgtgcatctatttctataaactcgttcattttgtctattttttgcacaaacatgaaatgtcagacaattccgtgacttaagaaaatttatacaaatcagcaacataccccttaaggagtatataaaggtgaatttgatttacatcaataagcggggttgctgaatcgttaaggtaggcggtaatagaaaagaaatcgaggcaaaaatgagcaaagtcagactcgcaattatcggtaacggtatggtcggccatcgctttatcgaagatcttcttgataaatctgatgcggccaactttgatattaccgttttctgtgaagaaccgcgcatcgcttatgaccgcgtacacctctcgtcttacttctctcaccacaccgccgaagagctgtcgctggtgcgcgaaggcttctacgagaaacacggcatcaaagttctggtcggcgaacgcgctatcaccatcaaccgtcaggagaaggtgattcactccagcgccgggcgcaccgttttttatgacaagctgatcatggcgaccggttcctacccgtggatcccgccaatcaaaggttctgatactcaggactgctttgtctatcgcactattgaagacctcaacgccattgaatcctgcgcccgtcgcagcaaacgcggtgccgttgttggtggcggcctgttaggtctggaagccgctggcgcgctgaaaaacttaggtattgaaacccacgttatcgaatttgcccctatgctgatggcggaacagcttgatcagatgggtggcgagcagctgcgtcgcaaaatcgaaagtatgggcgtgcgcgttcacaccagcaaaaacacccttgagattgtgcaggaaggtgtcgaagcgcgtaaaaccatgcgttttgccgacggcagcgaattggaagtcgactttatcgtcttctctaccggtatccgtccgcgcgataagctggcaacccagtgtggtctggacgttgctccgcgtgggggtattgtcattaatgattcctgccagacttccgatccggatatctacgccatcggtgaatgcgcaagctggaacaaccgtgtatttggtctggtagcaccaggctacaaaatggcgcaggtcgccgttgaccatattctcagtagcgaaaacgcctttgaaggtgctgaccttagcgccaagctgaaactgctgggcgtagacgtaggcggtattggtgatgcgcacggtcgcacgcctggcgcacgtagctatgtttacctcgacgaaagcaaagagatctacaaacgcctgattgtcagcgaagacaacaaaaccctgctcggtgcggtactggtgggcgataccagcgactacggcaacctgctgcaactggtgctgaacgctatcgagctgccggaaaacccggattctctgattctgccggcgcactcgggtagcggtaagccgtctatcggtgttgataaactgccggacagcgcgcaaatctgctcctgcttcgacgtcaccaaaggtgatctgattgctgccatcaacaaaggctgccacaccgttgcggcgctgaaagccgaaaccaaagcgggtactggctgcggtggctgtatcccgctggtcactcaggtactgaacgcggaactggcgaaacagggcatcgaagttaacaacaacctgtgcgaacactttgcttattcgcgtcaggaactgttccatttgatccgcgttgaaggcattaaaaccttcgaagaactgctggcgaaacacggcaaaggctacggttgtgaagtttgtaaaccgaccgtcggttcgctgctggcctcctgctggaacgaatacattctgaagccggaacatactccgctgcaggattctaacgacaacttcctcgctaacatccagaaagacggcacctactcggtgatcccgcgctctccgggcggtgaaatcaccccggaagggctgatggcagtgggtcgtatcgcgcgtgaatttaatctctacaccaaaatcaccggttcccagcgcctggcgatgtttggcgcacagaaagacgatctgccggagatctggcgtcagctgattgaagccggcttcgaaaccggtcatgcctatgcgaaagcactgcgtatggcgaaaacctgcgtgggtagcacctggtgccgctacggcgttggcgacagcgtcggcctcggcgtggaactggaaaaccgctacaaaggcatccgtacgccgcacaaaatgaagttcggtgtctccggctgtacccgtgaatgttcagaagctcagggtaaagacgtgggtattatcgccactgaaaaaggctggaacttgtatgtttgcggtaacggcggcatgaaaccgcgtcatgcggatctgctggcagcggatatcgatcgcgaaacgctgatcaaatatctcgaccgcttcatgatgttctacatccgtaccgccgacaaactgacgcgtaccgcgccgtggttagaaaacctcgaaggcggcatcgattatctgaaagcggtgatcattgacgacaaactggggctgaacgctcatctggaagaagagatggcgcgcctgcgtgaagcggtagtgtgtgagtggactgaaacggtcaatacgccgtctgcgcagactcgcttcaaacacttcatcaacagcgacaagcgtgacccgaacgtgcagatggtgccagagcgcgaacagcaccgtccggcaacgccgtatgaacgtatcccggtaactctggtggaggacaacgcatgagccagtggaaagacatctgcaaaatcgatgacatcctgcctgaaaccggcgtctgcgcgctgttaggtgacgagcaggtagcgattttccgcccgtatcacagcgaccaggtgtttgcgatcagcaacatcgatccgttcttcgagtccagcgtgctatcacgcgggctgattgcggaacaccagggcgagctgtgggtcgccagcccgctgaaaaaacagcgttttcgcttaagtgatggcttgtgcatggaagacgaacagttttccgtcaaacattacgaagcacgagtgaaagacggcgtggtgcagctgcgcggttaatgttttaacgggaggcgcaatgcctcccctttttgcatggtcctgtaatgaccttcggtatattgcaggacattttttaaactttttgttttatttttttgtttttattttttaaaggataatcaaatgtttacagacactattaataagtctgcggctaacgctgcgcgcattgcacgcctgtcggcaaataacccgctcggattttgggtcagctccgccatggcgggcgcgtatgtgggtcttgggatcatcttgattttcacgctcggtaatttgctcgacccgtccgtacgtccgctggtgatgggcgcgacctttggtatcgccttaacgctggtgattatcgccggttctgaactgttcaccggacacaccatgttcctcacctttggggtaaaagcgggcagcatcagccacgggcaaatgtgggcaatcctgccgcaaacctggctgggtaatctggtcggttccgtcttcgttgccatgctctatagctggggtggcggtagcctgctgccggtagataccagcatcgttcactccgtcgcgctggctaaaaccactgcaccggcaatggtactgttcttcaaaggtgcattgtgtaactggctggtttgcctggctatctggatggcgctgcgcactgaaggggcggcgaaatttatcgctatctggtggtgtctgctggcgtttattgcatccggttatgagcactccatcgctaacatgacgctgttcgcgctctcctggttcggcaaccacagcgaagcctacacgctggcgggtattggtcataacctgctgtgggtgacgctgggtaatactttatcaggtgccgtattcatgggattgggttattggtatgctacgccgaaagcgaatcgtccggttgcggacaaatttaatcaaactgaaacggctgccggttaattactaaggggtttttacgtggatcatttgcctatattttgccaattacgcgatcgcgactgtctgattgtcggcggtggtgatgtcgcggaacgcaaagcaaggttgctgttagacgcaggcgctcgcttaacggtgaatgcattagcgtttattccacagttcaccgcatgggcagatgcaggcatgttaaccctcgtcgaagggccatttgatgaaagccttctcgacacctgctggctggcgattgcagcgacggatgatgacgcgcttaaccagcgcgtcagcgaagccgctgaagctcgtcgcatcttctgtaacgtggtcgatgcgccgaaagccgccagctttattatgccgtcgattattgaccgctcaccgctcatggtagcggtctcctctggcggcacctctccggttctggcacgcctgttgcgcgaaaaacttgaatcactgctgccgttacatctgggccaggtagcgaaatacgccgggcaattacgcgggcgagtgaaacaacagttcgccacgatgggtgagcgtcgccgtttctgggagaaattgttcgttaacgaccgcctggcgcagtcgctggcaaacaacgatcagaaagccattactgaaaccaccgaacagttaatcaacgaaccgctcgaccatcgcggtgaagtggtgctggttggtgcaggtccgggcgatgccgggctgctgacactgaaaggactgcaacaaattcagcaggcagatgtggtggtctacgaccgtctggtttctgacgatattatgaatctggtacgccgcgatgcggaccgtgttttcgtcggcaaacgcgcgggataccactgcgtaccccaggaagagattaaccagatcctgctgcgggaagcgcaaaaaggcaaacgcgtggtgcggctgaaaggtggcgatccgtttatttttggccgtggtggcgaagagctggaaacactgtgcaacgcgggtattccgttctcggtggttccgggtattaccgcagcttctggttgctctgcctattcgggtattccactcacgcatcgcgattatgcccagagcgtacgcttaattaccggacacttaaaaaccggtggcgagctggactgggaaaacctggcggcagaaaaacagacgctggtgttctatatggggttgaatcaggccgcgactattcagcaaaagctgattgaacacggaatgccaggcgaaatgccggtggcaattgtcgaaaacggtacggcagtcacgcagcgcgtgattgacggtacgctcacacagctgggagaactggcgcagcaaatgaacagtccatcgctaattattattggtcgggttgttggcctgcgcgataaactgaactggttctccaaccattaatttaacccgggccagagaattctggccttcttaatgactctttttatatattcagcaaataaaacataaccccttaataaatattatctgctaatgggttatattcaccgttacagcgacttacaaaattaagtcattcgctcactgacgccaattaaatattcctgtatcgttcttaacgagcagtctgcttatattcatataatcaatgaatattaattaatatataatacatagggaatgtaaatgaacaaatttattaaagttgcactggtaggtgcagtactggctacgttaactgcatgtactggtcatattgaaaaccgtgataagaactgctcttacgactacctgctgcacccggcaatttctatttctaaaatcattggcggttgcggtcctactgcacagtaagtctctgacagaaatcggctaacaccggtttaattgcccgacgccctctggattttccgagggcgtatttgtttctatgtccttcttgcccccgcccgtaaaaatattttcactttaaattcaatttgataactacatccattagccacagcgcgatcctgtgcgaaattttgtgatcttcctccacattacataacatcatatgttgttatattcatcatgcattgtcatgttaccttttaaatgactgcaaactctcccctacaacgtattggacaagaaaaaggtatcgctatgggaagccaggaactccaacgcaagctcggattttgggccgttcttgcaatcgccgtcgggacaaccgtcggctccggtatttttgtatctgtgggtgaagtggcaaaagcagcgggcacgccgtggcttacggtgctcgcgtttgtcattggcgggttaattgtgatcccgcaaatgtgcgtctatgcggaactatccaccgcttatccggaaaatggcgcagattatgtttatctgaaaaatgccggaagccgaccgctggctttcctctccggctgggccagcttctgggccaacgatgcgccgtcattgtcgattatggcgctggcgattgtcagcaatcttggctttttaacgcctatcgatccgttgctcggtaaatttatcgccgccggattaattatcgcctttatgttgctacacctgcgctccgttgaaggcggcgcagcgtttcagacgctaattaccatcgccaaaattatcccgttcactatcgtcattggccttgggatcttctggtttaaagcggagaattttgccgcccctaccaccactgcgattggcgcaacgggcagctttatggcgctgctggcggggatctctgccaccagttggtcgtataccggcatggcctctatctgttatatgaccggcgaaattaaaaaccccggaaaaaccatgccacgagcgctgattggttcctgtctgctggttctggtgctctacaccctgctggcgctggtgatttccggcctgatgcccttcgacaaactcgccaattctgaaacgccgatttccgacgccctgacctggatccccgcactcggcagcaccgctgggatctttgttgccatcacggcgatgatcgtcattcttggttcgctttccagctgcgtgatgtaccagccgcggctggaatacgcgatggcgaaagacaacctgttctttaaatgcttcggccatgtgcatccgaaatacaacacgccggatgtctccatcatcctgcaaggggcgctggggatcttcttcatcttcgtttccgatctcaccagcctgctgggttatttcaccctggtgatgtgtttcaaaaataccctcaccttcggctccatcatctggtgtcgtaaacgcgacgattacaaaccgctgtggcgtactccggctttcgggctgatgaccaccctcgccattgcgtcaagcctcattctggtcgcctcaacctttgtctgggcaccgattcccggccttatctgcgccgtcatcgttattgctactggtctgcctgcttacgccttctgggcgaagcgtagccgccagctcaacgctttgtcgtaatgttatctggagaaaataaaatgttggatattgataaaagcaccgtggactttctggtcaccgaaaatatggttcaggaagtggaaaaagttctcagccatgacgttccgctggtgcacgccatcgtggaagagatggtgaagcgcgacattgatcgtatttatttcgttgcctgcggctcgccactcaacgcggcgcaaacggcgaaacatctggcggatcgcttttccgatcttcaggtctacgccatttccggctgggagttctgcgataacaccccgtatcgcctcgacgatcgttgcgcggtgattggcgtttctgactacggtaaaacggaagaggtaatcaaagcgctggagctgggccgggcctgcggcgcactcactgcggcgttcaccaaacgcgcggacagcccgattacctcggcggcggaatttagcattgattatcaggccgactgtatctgggaaattcacctgctgctctgctacagcgtggtgctggagatgatcacccgcctcgcgccgaacgcggaaatcggcaagatcaaaaacgatctcaagcagttgccgaatgcgctcggtcatctggtacgcacctgggaagaaaaaggccgccagcttggtgaactggccagccagtggccgatgatttataccgttgctgcgggtccgctgcgtccgctgggttacaaagaaggcattgtaacgctgatggaatttacctggacgcacggctgcgtgattgagagcggagagttccgccatggcccgctggagattgtcgaaccgggcgttccgttcctgttcctgctcggcaatgatgaaagtcgccacaccaccgaacgcgccattaactttgttaaacagcgtactgacaacgtgatcgtcatcgattacgccgaaatttcgcaagggctgcacccgtggctggcaccgttcctgatgttcgtgccaatggagtggctctgctactacctgtctatttacaaagatcacaacccggatgaacgccgctattacggtggtctggtggaatattaatccctctcccggcccggcaacgggccggatttacgcaaggagttacccgatgaaaacaggtatgtttacctgcggccatcagcggctgcctattgaacacgcatttcgtgatgcaagcgagctgggttacgacggcatcgaaatttggggcggtcgcccgcacgcgttcgcgccggacttaaaagcgggcggcatcaaacaaatcaaggcgctggcgcagacgtatcagatgccgattatcggctatacgccagaaaccaacggctatccgtataacatgatgctgggcgatgaacatatgcgtcgcgaaagcctcgacatgatcaagctggcgatggatatggcaaaagagatgaacgcgggttatacgctgatttccgcggcccatacgggctatctcacgccacctaatgttatctggggacggctggcagagaacctaagcgaactgtgtgagtacgcggaaaacatcggcatggatctaatcctcgaaccgttaacgccgtatgaatcgaacgtcgtgtgtaatgctaatgatgtgcttcatgcgctggcgctggtgccttcgccgcgcctgttcagcatggtcgacatttgcgcgccgtatgtccaggcggaaccggtgatgagttatttcgacaaactgggcgataaattacgtcatctgcatattgtcgacagcgacggggccagcgacacgcattacattcctggagaaggcaaaatgccgctgcgggaactgatgcgcgatattattgagcggggctatgagggttactgtacggtggagctggtgacgatgtatatgaacgagcccagactctatgcccgccaggcgctggaacgctttcgcgcgctgctgccggaggatgagagatgaaaaccctggcgacaatcggcgataactgcgtcgatatctacccgcaactgaataaagcgttttctggcggtaatgcggtcaatgtggcggtgtactgcactcgctacggcatacagccgggatgcattacctgggtgggtgacgatgactacggcacaaagctgaagcaggatctcgcccgcatgggcgtcgatatcagccatgtccatacgaaacacggcgttaccgcacaaactcaggtggaactgcacgacaatgatcgcgtttttggcgactacaccgaaggcgtgatggccgactttgccctgagtgaagaggattacgcctggctggcgcagtatgacattgtgcacgccgcaatctggggacatgcggaagacgcattcccacagctgcacgctgcgggcaaacttaccgctttcgacttctccgacaagtgggacagcccgctctggcagacactggtgccgcatctcgattttgcctttgcctccgcaccgcaagaagacgaaacgctgcgtctgaagatgaaagcgattgttgcccgtggcgcaggaacagtgattgtcacgctgggtgaaaacggcagcattgcctgggatggcgcgcagttctggcgtcaggctcctgaaccggtgacggttatcgacaccatgggtgccggagattcgttcattgccggattcctttgcggctggtctgcggggatgacattaccgcaggcgatagcgcagggaacggcgtgcgcggcgaaaaccattcagtaccacggtgcctggtaggtataacgttggcgtgagcatcttcacgccaacgtgctgttacttgccggaaaacgaccctataatccgagtaattcattctttatttcagggtcgattatgtcagctacggaccgctactctcatcaactcctctacgctaccgtccgccagcgactgctggatgatatcgcgcagggggtttaccaggccgggcaacagatccctaccgaaaacgagctttgtacacaatataacgtcagccgcattaccattcgcaaagccatcagcgacttagtggcagacggcgtactgatccgctggcagggaaaaggcacctttgtacaaagccagaaagttgaaaacgccctgcttactgtcagtggttttaccgattttggcgtctcacaaggcaaggcgacgaaagagaaagtgatcgaacaggaacgggtcagcgccgcgccgttttgcgaaaagctgaacatccccggaaacagcgaagtgttccatctctgccgggtgatgtatctcgataaagagccgctgtttattgatagttcatggatcccgctgtcgcgttatcctgactttgatgagatttacgtcgaaggaagctccacctatcagttatttcaggagcgttttgacacgcgagtggtcagcgacaaaaagaccatcgatatctttgccgccacccgcccacaggcaaaatggctgaaatgcgaactgggcgaaccgttgtttcgcatcagcaaaatcgcctttgatcagaatgacaaaccggtgcacgtctccgaactcttctgccgcgccaatcgcatcaccttaactattgataataaaagacattaaccgtaggccggataagatgcgccagcatcgcatccggcgatgctggcgcgttgaattttacatcccgtacgttcccctcaccctaaccctctccccaaaggggcgaggggaccgttcagtacggaatttagcttgacggtgctatccagcattaaatactggcaatactctcacgcaaaatccgcagcaccgtctcttcaccgctgcgattcgggttaatgcgaatcgcgcaatgttcgagctgtggattcgcctggcgaaacgtcccggaaagtcgataaaaaagtggcgggatttcatatttcgactctgcaccgaccgggtaaggtaaggcaccgcgtttctgcgcttcttccagcaccctggcggcaatcggctgatgaaactccacaatcaataccttcgactgcgcattagcaatgacggcgcttttcacttccggcactgcaccaccgttgagcaaagccagcaaccgttcagatacccccgcctgcaccgcgtgcatcactggcgcaaacaccagaccacgcaagacttccagcgcctgagcgccctggatctggctaccgcctgagtaaagcgtggcgcgaatacggttgataacatcagcatcgccgaccactgcaccaacaccctctggcccaaatagcttgaagcaggaaaatgtcgagacattcgcgccgcattcacagccgattcgcgccaccttcatcaccgcatagttgtcatcggttaacgctggaacacctgccgcgcgcaacgttgccagcacatctgccagcacgtagctgtcctgcggctgctggcgcgtatgctgcaccagcgccgcatccggttgttgctcgtcgacgacctgcttcagtgccgacaggtcattgaaatcaacagtaataagcgtcagccccatctgctcaataataacccgtgtcgtcgggtaaacaggcgcgtcatgcaccagaagacgctgccccggtttgagcaaagccgccagcccggcgcgaatcgcgccagtccccgcgccctgcaccagcgccgcagcctgtgcgtgaaatgcatcagccagcacctgttccacacgctgggtaacgcgcggttgattcagtcctggcgttaagcctaaatcaccgccagtaagaaactcgctgccggggaaatggcgacaaatgctatccaccagcgcaaactgcttttgctgcgcctcaataatcgtcaggctttgcagaggaaacgtcttcataggtgccttccttaagccggaacgaacaggccaagccagtaaagaacattcagcagaataccggtgatcattacggccacgaccggtgccgccattttctgtaccggacggcccagggattcgttgaggaagtaaatggcaaccgcgatagagaatccggtataacccgccattttaattgctgcgaaaatcgaaccgaccagcagcgccacttccatcagcatattcatggcgttacggatgttatccgacgcattacgcaccgacggatagcgccccagccatttgccgatcgaacgaagtaacaggacttctgccgaaataaccactgcgcctaataccgccgcaaccatcggattcggcgagagatagcccaccgcataaacaaaggtaaagcccgcaactgcatatacgccggtggctaacgcggtggtggcaatcaacggcacaaaacccagtccgcgcataaactccgccagagcagcctggttgatcagcgtttgcgattgttccggcgttacgcctgcggagtacgctttctccagagtgaagatcgacacttcactgccggcgaaaatcttcatactggcaacggcggcaatcaatgctcccacgatggcgatatagggtaagtttttgataatccgcgacgtgcgctcttcaaacaccgaaagcccgctggcatcgatgtcattttcatcacgatgacgcaggtcgtgagttatcgcgattcccagcagcatcaccatgccaataaagatttcgatggattcagggttaagatgtgggaaatagcgcacgactaccacacgggtcatcagaacaaccacggcggcgaccagactttgcttccagccaaactggtagaaaatcgccaccaacgggaagagtgcaaaagcagaaaccaccggcgagcttaattccccgaggctacctaatacatccaccggcagcgcggtcagcagctggtttactggcaacaggcaagtaaggatcaacacgccccagatagcgccaagaccaaacgccatcaggctgtttatcgccagtacgccgaggatatcggtaggaagaaagagtaaccatgcgtttagcagcccggttttcagggtaaaagagatccccaccgaggccacaaaaccaatgctcagaccaaaagcgatactccccgcctcgcgacggttcatatagccttcaatcagttgcggcaggatcgggcggatgccgtcatgaaaaacagccgccgagcgatgcgccagaagcgatgtcatacccgtcaggcacgccaccacgataatctgaatatacagatccatagtcgtgccttttatttcagatggttaatcagcatcggaatcgcgtgttcgacgtgctcaacggaaaggccaaacgccacttttccttcagcgatcattttggcgatatgctcgtctttcgctttaatgcctggtttggcaatggtgcaacttttgttatagccaatcaccgcgatggcaatcgacaatgccgcgcccgcaccggtattacacgcaccgatgtagtaatccagttgcccggatttcactttcattgccgcttccatgtcgttgtgaatgaaaacttcaaaactgccaggagccgtcgcttcaatggtttttttaatctgctcacgctgtaagcctgcaacgccaatctttttcatgagtctgtccttattggaaaaattgagagggagtttcacgtaacatcacatccacatcggcctgactgaatcctgactggcgcaattgcggaataaaggtggtcaataaatagtcatagccataaccaccattggcttttaaatgggagcggcgcgtaatatccatcgacagcatgacgcggttcagcaacccacggtcacgtagcgcatgaagcatcgcaatacgcttttcgtccgggtagtaactgttcttaccaatggtgtcgaactgcacgtacgcgccgagatcgatcatcttcaaaatgttgtcgaggttgtctttcagatcgcagtgaccaacggtgacgcgcgaaagatcaaccccgtgggcttgtagcaacgccagttgctccagccccatcgtgctgaacgacgtatgcgtggagatcgggcgtccggtctggttatgcgccagcgcagcggcaataaataccttctcttccagcggcgtaatctttccttcgctggtgccgatctccgcgatgatcccggctttcagctccgtgccatcgataccctgttcaatttcatcgaccatctcctgcgccagttcctgcacgctgcgggtcgccacatgttccgggaaatacgcgtcctggtaataaccggtacaggccaccacgttgatccccgtctcgcgcattacatcaagcataaattgcgcattgcgccccatgtaacggttggtcatctcaatcacattacgcacgccccgggtcatcaggtcgttcatctcctggcaaatgaacgcatactgatcaaggcggcagtccacgttgtttttaaagccggagagatcaatatgcagatgctcatgggcgagggtgtaacccgtcggatcaaaactcatagggtgtctcctgcaaaccggagggaggaaagaaaagagcgaccattttgtggcggtggcgcgcggaaaaattcacacacggtagcccccacatcagaaagcgtggtgcgcacaccgagctgcgtagcgatcatcccttgctgataaaccagcactggcaccacttcgcgggtatggtggctgtgaccaatggtcggatcgttgccgtgatccgccatcacgaccaggcaatcatctggctgcatcgcctcaacaagccgggcaaggttacggtcaacgacctgcaaacgttcggcataacgtgcgacgtcttctgcatgaccagcgaggtcggtttcctgaatgttggtgcaaataaacgccgtcggatgggtgttaaattcgttgagggtgatatccataatccgctggctatccaccagattttgccagctcacgccataaggattgttgacgatatctgccaccttacccaccagcacggttggcacgcctgcttcatacagtttttgtggcacctgcactttttcatcgacgccatagcccatatgcacgacctggaaaccgttgtcataagcgccagaacgcggcgcattgataccaataaagcgcccttctttgctttctgcggcatcgagaatgcgttgactgtcggttaacaggccaccaaatgtaatgacccgaccgacctgtacctgctcacgcacgatacgaccaattttgattgcgtcgtcaaaagagatcacagagagattggcggtaatgttatagacctggcctaaatccgcctcgagattatcgccaatcgcaaccgcctgattgacccacagaaattgcagttcatcgccacggcgctccacctgccaaccggcggatactaatgcctgctcaacacggtcaatcacatcgcaaaaaggcatccgcagcggcggtaacgggcgcgtgcctaaaatttcctgatgccccataaaggtatcgccaccttcatgttgcagctctgccacgccccaggttgcggaatctgacggctgcatatcgcctggcgcataacccaatgcgttgattagccccagcttctccagcgttggtagctgcaaatgcggcaactggctcaggatgtgaccacaggtattcgctcccgcatcttgcggacgcaccagcgtgacatctttcattgcccctacgccaaagctatcaatcactaacaccacaaatcgcgccattacgcccccagagagtttccaagactgtcataacgaccaacgattttcggttcgccacggtgaataccggacaccagcaccacatcgctacgggtgacaaaaatctgcgtgcggaaacagagcaccactgcactgctcaccggatactcgcctgccagcggcagggtgtagtcgatactgctgtcatccacagttttgagattggtttcagtaatcttttgattttctggcgtaaacaccagcgcatgttgcgcatgaccacgacgatagtaaccgccgccgtagcagtagctgtcgccacggaaatgatgggagatttcacttaaccagagcatcgcgatacgttcaggctgatcgccctgctggtttgccggaatagtgcccgtcagcgcatgaccgggttcggcatgagtcacaccgtattgcgccagtaatggcagcgaagtgcagctggtcgctgaaggcgcgttcagttgctcaagtgcaataccagatttcgccagttgatcccgtgcctgtatcagcgtgtgaagattcggtgtcggcaaaacttttccgacagcctcatcccaaagcaggcaagggaaatgggtaagtccggctaaatgcagccctggcagattctggatttcggcgacaatctccggcaacaccttgagggcaaaaccgctctcctggcccggataaagaaaatcatcgtcgctataaactttaagcagcacagactggattcgcccggccttcaccgccgccgcagaaacttcccgcgctttgtcgagagtaaacacggtgatgacgtcggtgccctgttcaacggcgtcagcaacctgatgacaagggatttgtaccagatgcccctgatgcgccacaggcaaaccagcgcggcgcatgactcgcgcctctttgtaatccaccgccacaatgccgctgtagcctaatgccagcaatttttccgccagccacggattacgaccaaactgcttggtcatcagatacagttcaatgccgtaaagccgcgccgcctcaatcagccgcttaccgttttccagtatctgatccacgtcgatcacccagctgtccggggcgatcttgccctgctgccacaggcttagtgcggcggaaatcagcgccgggttctggcgtttcaatgcttctacaaacatcttgttgcctcgtttctgttccttgaattaaatattcatttttttgaatatttaggttgtgcgacgtggatttgtcgggagcttcaaacctcttcgttagcagccatccataatccataaaggttggccagcaaatagccttcttcacacgggttaacttccagtgcgaattccttcaacaacacctgatgcaattgcacaacggcttgccagtggctggattgcgccagctctgccagcaactcgttatccagtggctcaatttcttcaccacggcgactgcgcatcagtgcactcgccatatgtgtcatcgccatcgttccttgctcactgcgcaccggcagatggcactctgtttccagtacgttgacgacctgcatcatgcctttgcagatgtccttatcaataacgcctgcatcgcaaagcaggttgagtctggtttccatatcagatgcctttcgtttaataactcggttcctgttccccactcaccacccgttgttgatgggcaagcagggcgtgtttatctacaacggcacgcagcagttgttgcattgggtaatcatcgactcgcgtcaggaccacggcttcggtggcctgtaaaaatcgcggatcgtctgtgagcggcgtcgcctctaatcccagcatggtcagttcgttttccgccaccacgttccagataaccgcatcaacatcgcctttaacaatgcgttgtaaactctcgtgataagagagatcgactcgttccacatcactatcgccaaaaaagacatcggtcatgattttctgatccgccgaacggttatccagccccacgcgcttcacatttgcggactcgcctttacggcaaatcaactggtgttcgccaacgtaggtgtgcggccccaactccagcgcgagacataaccctttttgcgtgagataactttccgccgccagtcgggaaaccaccgccatgtcatacacgccattaagcagacactccacgcgaatatccgcgccgcgcatatgcgcatagtaaaaaggaatgccatcaaactgagctttcaatccgctcgccaggccttcgtacaaacgggtatagggcaagggcatcgcacacaccacgttgttgatatccacatgagtcagtaatgctttgttatccatctcgaccagataactgccattacgcccacggcgttcaatccgtatcgctccgcttgattccagcgttttcaacgcggcctgcgtcaggccaacggatgaacggcattcagttgccagctcatctatggttttcaacctattaccgcatttttcacccaacaaataacgggccagcgtcgtgatgacgacgccttcttttttgataaacgttcgacgcataataaattttcagtaaattgaatatttatatcttcaggaatttgaagataaggcgcaacagcgagatgtggaaacggcgaggcacttcacattttttcggattattgcaaatgaggataaaaaaaccgggtttccccggtttcagagtgatgataaaagcaaaattgcctgatgcgctacgcttatcaggcctacatttccttgcaatatgtgcattactttgtaggccggataaggcgttcacgccgcatccggcatgaacaaagcgcaatttgccagcaatagtgaattacggcttcgccacaaaaccaatcgcttcgtataccgcttttagcgtacgggaagcgtgcgcgctggctttttccgcgccatctttcatcacttgttgcaggaaggcttcatcgttgcggaaacggtgatagcgttcctgcaattcagtcagcataccggaaacggcatcagccacttcgcctttcagatgaccatacatcttgccttcgaactgtttttccagttccgggatgctctggcccgttaccgcagaaaggatatccagcaggttggaaacgcccgctttgttctgcacatcgtagcgaactaccggcggctcgtcggagtcagtgaccgcgcgtttgattttcttcactaccgatttcggatcttccagcaggccaataacgttattgcggttatcgtcagacttggacatcttcttggtcggctccagcagcgacattacgcgcgcgccagatttcggaataaacggctccggcaccttaaagatctcgccatacagcgcgttgaaacgctgggcaatatcgcggctcagttcgaggtgctgtttctggtcttcacccaccggtaccagattagtttgatacagcaggatgtccgccgccatcagcaccggatagtcaaacagaccagcgttgatgttctcggcataacgcgcagatttatctttaaactgcgtcatgcggctcagctcgccgaagtaggtatagcagttcagtgcccagcctaactgcgcatgttccggtacgtgggactgaacaaaaatggtgcttttctcaggatcgataccacatgccagatacaaggccagcgtatccagcgtcgctttacgcagcttctgtgcatcctggcgcacggtgatcgcgtgttggtcaacgatacagtaaatgcaatggtagtcatcctgcatgtttacccactgacgcagcgcacccatgtagttaccaatggtcaattcacctgagggctgtgcgccactaaaaacgatgggcttagtcatttttcgattcctgattttcgctatgcggaagccctaatgcgggcagaaggtcatttatagactgataaattacatcaggctggctgagatcgatagcctcgccgtagttatatccgtaggttaagccaacggatgggcaacctgccgcttttgccgcctgaatatcattgcgtgagtcgccgacaaacagcatctgttgtggggcaattcccatccgctcagccaccagtaacagcgggtccggatgaggttttttgttttgcacatcatcgccgccgataaccacgctaaagtatttggcaatatctaaggcttcgagcagcggcgcgacgaacggcgtcggtttgttggtgaccaggcctagcggcaggcctttagcctgcaacgcgcccaacgtatcggcaacgtgcgggaacaaaaacgtcccctcttcggcaacctcgccataatagcgatcgaacagtttacgcagaatacgtacctgttcttctgccggaatgtcgtcatcaacgggcggtttacccattgttttacgcagagtcgcacgttcctgacgcgcccaggtcaatgcgcgctccatcagaacatctgcgccgttaccaatccaggtaataacgcgttcttcacctgcgacgggtaactccaacgcatacagcgccatatctaccgcagcagcaagaccgggagcactgtccaccagcgtaccgtcgagatcaaaagcgacgccgcgaatatcttcaaacttactcatgacttacctttgccagttcactgcgcatttcatcaatgacttttttatagtctggctggtcgaagattgccgaaccggcgacgaacatatccgcgcccgccgcagcgatttcgccaatgttgttcaccttcacgccaccgtccacttccagacgaatgtcaaagccagactcgtcgatacgacgacgtacttcgcgcagtttatccagtgtttgaggaatgaaagactgaccgccgaaaccaggattgacggacatcagcaggatcacatccagcttatccatcacgtaatccagatagctcagaggtgtcgccgggttaaataccagacccgctttacagccattttctttaatcagttgcagcgtgcggtcaacatgctcggaggcttctggatgaaaggtaatgatgctggcaccagcggcagcgaaatcaggaacaatgcgatcgacaggtttcaccatcaggtgtacgtcgataggggcggtaatgccatagttacgcaaggatttcagcaccattggcccaatcgtcagattgggaacatagtggttatccatgacgtcaaaatgcacgacatcagcgccagctgccagggcttttgcggtatcttcacccaggcgggcaaaatcagccgacagaattgagggggcaatcaaatactgtttcatccgcttctccttgagaattattttttcgcgggtgaaacgactcctggtttgtacaaagccagcagttcgtccacctttttacgtgtgccgccgttgctgcttatactgcgtcgaactttgacgacatgcaattttgcgcgctgataccactcacgcgttaacatcgtatcgtgattggagatcagcacaggaatatggcgctcaaccagaccttcggcgatctccgccagatgcgcttgttgttcaagcgtaaaactgtttgtgtgatacgccgtaaagttggcggtcgcagacagcggtgcataaggcggatcgcaatagacgacggatgcatcatctgcgcgcgccatgctatcggcgtaagactcacaatagaaaaaggcattctgcgctttttcagcgaagtgatacaactctgcttccgggaaatagggttttttgtagcggccgaacggcacgttaaactcaccgcgcagattgtaacgacacaggccgttgtaaccgtagcggttcaaatataaaaacagtaccgcccgacggaacggatcctggcttttgttgaactcttcgcggaactgatagtaaacctcggcgcaatttgtttcgggaacaaacagctcgcgagcggcctgtacgtactcatcagtacgcatcttcacaatgttatagagactgatcaggtcgctattgatatcggcaaggatataacgagaaaagtcggtgttgagaaacaccgacccggcacctacaaaaggctcaaccagacattcgcccttgggcaaatgccgtttaatatcatcaagcaggggatacttgccccctgcccacttcaaaaaagcgcgatttttcttcatgctgactaactaattacaccttctccggctgtggagaaagctccgacagcatccagcgcttcaggcaactcccgcaacgataaaccattgcgggagataaccttgattacttcagatcggcctgtacctgacgcagcggtttcgcccacgggtttttggcctgaacatctgctggcaatgtagataccgcttttttcgcctcttctttcgaagcgtacacgccagaaaccaggacataccacggctgaccattacgcgtcgtttcatagacaacgtagtttttcagattctctttcttcgcccaaccgttcaggttgtcgtagttagaggaactgctcagctgcagagtgtaatggctggacggtgccgatttcaacgaaccaacattacctgcggtcttccctccagcggctggtgttgccgtggtttgcgccggggatgccgtctgtactggagccgtagtcgccgtctcttttggtgctggcgttgcggctggcgtagaagtcgcagccggtgccttcgtgctcgccacaggggcagctggttcagtacgcttcggcgtctgtgctaccggcttcggttccgttttcacggttgcttgcggttttttcggttcaatcaccgcctgctgacgagctggacgcgtagtggccggacgttcagcagtttgcgttttcgccgtgtcacgcgatgcattgccattgcgtactggcgcgacagtcgcgggttcagtcggcaatgtagaattgaccgccacattgttcaactgttgctgattttgtggctgggtcagcgcattgttcaggtcaccctgcacttcaacacgttgttgaccatccgttgcgaccggggtttgcccttgagtcggcgtagaagagatcggtggcagagaaacatcctgctgagtattttccgcagacgtggttcccggcgctggctgcacgccattcgcctgatcggtcgcattgccagcaagatcaatactcttctcgccagacgcggtttgatcgctggaagtggtcgagggggcttttagcgcagaaccgataccgatgatcaacagcagtagaaccagaatgccgacgcccatcatcatatactgacgagaagcgggtttactggctgcttttttgcgcttacgcggacgacgctctacgcgctcttcatccacggtttcatcttcggattcgtcaatttcttcttcgatttccggttcctcattgcgctctttttgcgcacgagtcggacggcgatcgtcagtgtcatcaagttcaatatcatcaaaattgatctgcggttcgccacgttcagtacgcttagaacgttcagaagattgacgagaacgaccagtacgacgatcgctgggatcgggtttcagctcgtcttctggtttgaattcatccatttaacaccccactaaaaggttaatgcttaccacgttgcaattaacctgaagctaatagaccgcttgataagcggcctgacctttcttgttgttacgctgattgacaatcggcaatggcgttaagaacaagctcgtgcgaaacgccgctgcgaacttcactcttaccaattgccaacggaagaattaagcgtatctctcccgcaaggactttcttgtcacgcagcatatgcggtaaatacgcctgcgcggacatttcgcgcggcccattgaccggtaacccagcccgcgtgagcagggttataatacgctgcgtttcggcagaactaaactgcccgagacgttccgacgtccgcgccgccatcaccatacccgcagcgaccgcttcaccatgtaaccaattgccataccccatttcagcttcaatggcatgaccaaaggtgtgtcccagattcagtaaagcacgtaacccggtttcgcgctcgtcggcggcgacaacttctgccttcagttcacaacaacggcgaatacagtacgccattgccggaccgtccagacgcaacaacgcatccagattctcttccagccagttaaaaaacgcaccgtcaagaataatgccgtatttgatgacttctgccagccccgacgctaactcacgcgggggaagcgttttcagacagtcgagatccaccaccactgaagcaggctggtagaacgcgccaatcatgtttttaccgaggggatggttgaccgcagttttgccgccaacggaggaatcgacctgcgacagtaacgtcgtcgggacttgaatgaaacgaacaccgcgctgataactcgccgccgcgaagccggtcagatcgcccactacgccgccgccaagcgccaccagcgtagtatcgcgaccatgcggcttttgtaacaacgccgtaaagacggtatcgagtacagccaggcttttatactgctcgccgtcagggaggataacgctatcgacgttaacacccgcctgttcaagtacgccgcggaccttatcgagatacagaggagccagggtttcgttggtgaccaacatgacctgctcgcccgatttcagcggtaagaatgaagctggttcattaaacaaaccagatgcgatggtaattgggtaactacgttccccgagagtaacgacaatcctctccataacgcgacatccaccttaattactgtacccgcagacgagtgtatataaagccagaattagttgctttccagcatgtgaataatctggttagcgaccactttagcgctttgatcatcagtacgaatggtcacgtcggcaatctcttcatacagcggattgcgttcattggccaacgcttccagaacttcacgtggcggtgtttcaacgtgcagcaacgggcgttttttatcacgctgcgtgcgtgcaagttgcttttcgatggtcgtttcaagataaacgacaacgccacgagcggaaagacggttacgcgtttcacgggatttcacagagccgccgccagtagccagcacaataccctgtttctcggtcaactcattgatgaccttttcttcgcgatcgcggaagccttcttcgccttctaaatcgaaaacccagcccacatcagctccggttcgtttctcaatctcttgatcggaatcgtaaaattccatattgagttgttgagctaactggcgcccaatagtgctttttccggcacccataggcccaaccagaaagatattgcgtttctctgccattttttcggtactactaagactattcgttaatgataaacccgcttcgctcagagagcgccgcaggacatgaactgaaacctcataagatattgcgagagtcagactgaaaattatctcaatactccagcgggtttggcaactgaataaatcacccatccctctgcatatctggtcgctgcaagcgcgctgccttgctaccaccgctctggcgataaatcaccgggtaagattagcgtaaaaaagacagcaaaatgccgcctgaatgataaatcatcatcatggaacgcaggcagcgaagagcaccaactctcaaatcggtactccttgtatgctaaatacctgcgcgcgtcaaatagatgaaacacgttcagcgtaaaaacattaccgcttttacggctgtttactcactggaaaccagtcgtggcgtgataaacaccactaactcgcgtcgttcatcttcttttccgtcatgacgaaataattgcccgaacaagggaatgtcgccaagcaacggtacgctatcctgacccgatttatttttacgggtaaaaatgccgcccagcgccaacgtttctccgcttttgacctcgacctgcgtttcgatctcctgcttatcaatcgccagcacttcgccatcagcctgctgtagcacctgccccggaacgttctggctgatgtgtaatttcagccggatgcgacctttttgtaacaccgtgggcgtgacctccatccccaggacggcctctttaaattccaccgacgtcgcgccactttccccgctggaaacctgatatggaatttcgctcccctgtttaatgctggcaggctgaagatgtgaggccagcagacgcggactagcgataatatccagctgctgtttttgttcgagcgcagaaagctcaagatccagcaaacgtccgttgatgcgcccaatgttaaaaccgacatgcgttgtcgccgtcgctacggagaggtcgctaccaagcgtggtgacttgcccaacgccaccagcgtgttgcgcatcggccagcgtccatttcacgcctaactcacgcaaacttttttcattaatggtgacaatatgcgccgacagctcaacctgcccgaccggcagatccatttgcgctacccactgttcaagtgcgcttaacgccgttttgttatctcgtagcaaaaggcgattggtgcgtttatcgacggtcatactccctttggcactcaatagcttctcccccgctttcgccagttctcccgcgtcggcgtattgcagggttatactgcgattttccagcggcagatttgcctgcgcccgcgcctgctccgcctcctggcgggcgatattgttattctgccaggcaatggaatgcactgagagaatgttgccctcctggcgcgttatcagtccggcgcttttcactacagtttgtagtgcctgcttccagggaacatctgttagatgtaacgacaccgtaccgctgacgtctggcgacacgaccaggttcaacttctcctgttcagccagcgcctgcaacacctgagctaccggaacgtcatccaccatcagcgtcactttttgcggctttgccgcttgtacgccgggtatcagcatcaacagtagtgcggctatccattgcttcatttgtatctccttgccgttgccacaaccattgtggcggttcgcagtttgtcccggttcccagcgttagtgcgtctggcgtcagctgtaaaattgtccagccgttttccagcacatcgttttgctgcacccgtcgccatttcttttgcccgtcttttattacaccgatgatgtgctcgcctcgccctaccatcccctgatagcgccactggctaagttcgctaatccggcatagatcttccggcggtttaaaagggtcacgcataccggttaaaaggcacaatgcaacacctgccaacaaccagcgtttaaccctcatgcggcgtctccagttgtagcgtgaacaaaagatcatcaccttccacgcttaacgaaaaacggctcacgctgacgttgcgctctgccagccgtgtaaatgccgacggcactgcttcccacagcgttttcaacgccaactcgcctccctgcgcggatggatgccaggaaaccagttgcgcgccggataactgaaaatccagtggcgaaaagggcagcgttttttcctcgctgaagggagtggtgtctaccaggcgatacagtgcggcccactgctggtgatgacttgcccgtagtcgaattaatgcgtcgctctcttcctggtgtgtcgatgacagaaaaatgagcgtaactaacatcagcaaccagactgcccagcaaagctggcggagacggggtgatgtggcgaaccaccagtcaaagaacatgttcatcgctaaccttccttgttaactgatactcaaattgccagcgtccctgcgcatcctgctgcgtggccccccgctgattgagatgaaaagaagcatcctggcggagtgacgtttccagtgcgtttaacgcggtaatgcttgttgtaagccccttgatctccagcgttccctgctgccagcttatcgttgtcagccaggcgtgctcgggtaaaagcgccgccagagcttccagcgcagattgccagtcgcgggtaaattgtcgctggcgctgccgttgcaaacgctgttcgcgtaactgctgttgctccagcaaacgtggtttcgttatctgtaagctgtgggcgagttgttgttccccctgaagcaaaacggcgtctatgcgcgcttcggcgctgcctgtcagacgcagtattagcgttatcccgacggccagcagcagaggcgcaacgaacatcagcaaccagaaacgcagaaaagcggtccggcgttgctgtcgccagggcaaaaaattaattggcgggttcatcagtacgccttcccaagcgccagccccagcgcgatggcaaagtctccaccaggcggcggtagcggcggctgacgaacagaaacggcctcccagggatcaaatccgccttcgccacatatcgcgacgctgtcgggatcaacggataacgctgccgccagctccttcgcgctagtcatccctaccgccagtttgcgcccccagctatagcgcgtcgcccacagccactgttcgttatcacgccaggccagacattgctgatgagaaggtaaaaaaggcaggaattgctgtaatgcactggcatccggggtgatcgcgctcacatgaacacgcaacctttctgccagagtaagtagcgttgccagctctttgctttgcgcggcagtcacgttataagcggggctgagtgagtcttcgctgtaatcgaagcgcagggagtccggatccatatccagctcgcgggccatcgtcccagacagccaggccatttgctcccgctcaccgagggacatcgacgggcgcggaaatgaccgctgtaatgtgcgactggcgggaaacgccaacatgatgtgatggcgctgcggcagttcgcgactccacggcaacaacgttttagccagccgctgcgcatcaacaatccgcccatctttgataatgtcgtgcgccaacggcaaccgccaccagcgttgcaaaaagcattcttttgcgtcccgcacgatcgcaaccgctaacgcttcttgctgttgtaaatgcaaaccaatttgccagatcttaaatgccattgtgatgatctccttatcacccgtcactctgacgggtatatcaatgcgtctggcttgcctttatactaccgcgcgtttgtttataaactgcccaaatgaaactaaatgggaaatttccagtgaagttcgtaaagtattttttgatccttgcagtctgttgcattctgctgggagcaggctcgatttatggcctataccgctacatcgagccacaactgccggatgtggcgacattaaaagatgttcgcctgcaaattccgatgcagatttacagcgccgatggcgagctgattgctcaatacggtgagaaacgtcgtattccggttacgttggatcaaatcccaccggagatggtgaaagcctttatcgcgacagaagacagccgcttctacgagcatcacggcgttgacccggtggggatcttccgtgcagcaagcgtggcgctgttctccggtcacgcgtcacaaggggcaagtaccattacccagcagctggcgagaaacttcttcctcagtccagaacgcacgctgatgcgtaagattaaggaagtcttcctcgcgattcgcattgaacagctgctgacgaaagacgagatcctcgagctttatctgaacaagatttaccttggttaccgcgcctatggtgtcggtgctgcggcacaagtctatttcggaaaaacggtcgaccaactgacgctgaacgaaatggcggtgatagccgggctgccgaaagcgccttccaccttcaacccgctctactcgatggatcgtgccgtcgcgcggcgtaacgtcgtgctgtcgcggatgctggatgaagggtatatcacccaacaacagttcgatcagacacgcactgaggcgattaacgctaactatcacgcgccggagattgctttctctgcgccgtacctgagcgaaatggtgcgccaggagatgtataaccgttatggcgaaagtgcctatgaagacggttatcgcatttacaccaccatcacccgcaaagtgcagcaggccgcgcagcaggcggtacgtaataacgtgctggactacgacatgcgccacggctatcgcggcccggcaaatgtgctgtggaaagtgggcgagtcggcgtgggataacaacaagattaccgatacgctgaaggcgctgccgacctatggtccgctgctgcctgccgcagtcaccagcgccaatcctcaggaagcgacggcaatgctggcggacgggtcgactgtcgcattgagtatggacggcgttcgctgggcgcgtccttaccgttcggatactcagcagggaccgacgccgcgtaaagtgaccgatgttctgcaaacgggacagcaaatctgggttcgtcaggtcggcgatgcatggtggctggcacaagtgccggaagtgaactcggcgctggtgtcgatcaatccgcaaaatggtgccgttatggcgctggtcggtggctttgatttcaatcagagcaagtttaaccgcgccacccaggcactgcgtcaggtgggttccaacatcaaaccgttcctctacaccgcggcgatggataaaggtctgacgctggcaagtatgttgaacgatgtgccaatttcccgctgggatgcaggtgccggttctgactggcagccgaagaactcaccaccgcagtatgccggtccaattcgcttacgtcaggggctgggtcagtcgaaaaacgtggtgatggtacgcgcaatgcgggcgatgggcgtcgactacgctgcagaatatctgcaacgcttcggcttcccggcgcaaaacattgtccacaccgaatcgctggcgctgggttcagcgtcctttaccccaatgcaggtggcgcgtggctacgcggtcatggcgaacggcggcttcctggtggacccgtggtttatcagcaaaattgaaaacgatcagggcggcgtgattttcgaagcgaaaccgaaagtagcttgcccggaatgtgatattccggtgatttacggtgatacgcagaaatcgaacgtgctggaaaataacgatgttgaagatgtcgctatctcccgcgagcagcagaatgtttctgtaccaatgccgcagctggagcaggctaatcaggcgttagtggcgaagactggcgcgcaggagtacgcaccgcacgtcatcaacactccgctggcattcctgattaagagtgctttgaacaccaatatctttggtgagccaggctggcagggtaccggctggcgtgcaggtcgtgatttgcagcgtcgcgatatcggcgggaaaaccggtaccactaacagttcgaaagatgcgtggttctcgggttacggtccgggtgttgtgacctcggtctggattggctttgatgatcaccgtcgtaatctcggtcatacaacggcttccggagcgattaaagatcagatctcaggttacgaaggcggtgccaagagtgcccagcctgcatgggacgcttatatgaaagccgttcttgaaggtgtgccggagcagccgctaacgccgccaccgggtattgtgacggtgaatatcgatcgcagcaccgggcagttagctaatggtggcaacagccgcgaagagtatttcatcgaaggtacgcagccgacacaacaagcggtgcacgaggtgggtacgaccattatcgataatggcgaagcacaggaattgttctgattaaaaaggcgcttcggcgcctttttcagtttgctgacaaagtgcactttgtttataccggatacggcgtgaacactttacccgtctagcaacatctagaaaaatcaatatattgcagaaacttcgtaagcctgataagcattatgcatcaggcgaactttacgcatttacactcgcccctgccctttcaaccattcgcgcacgaggaacagcgcgctgacattacgcgcttcgttgaagtcagggtcttccagcaaatccatcatatgcgccagcggccagcgcacctgtggtagcggctctggctcatcgccttccagtgattccgggtagagatcttgcgctaccacgatattcattttgctggaaaaataagacggtgccatgctgagcttcttcaaaaaagtcagatcgttcgcaccaaatccaacctcttcttttagctcgcggttagcggcttcgtagacgctttcacccggatcaattaatcctttcgaaaaacctaattcgtaggattcagttcccactgcgtattcgcggatcaggatcaggtgatcgtccacaatcggcacaatcatcactgcttcccggttggttggacgcattcgttcataaacacgccgcacgccattgctgaactccagatccacgctctcgacggtaaacagtcgggaacgggctacagtttcaacattcagaatggtgggtttttgtaatgatttgctcatcgtgggatctatgctgtgaaatcagcggttattgtgcgatatcggacacgctttcggcaatgtgaattgcatgttatttacatttatgtaacttaataaataatcgtcctcaaatcaaattaaaagtcaataggttgaaataactccaggaatttgctgatattccgccttcagagggtttgctatgatcagcggttactgtgatgtgcttaatgatgctcaagttaaactccacgcttgccgatagccaaccgcagaatcatgtattgtgtccggtgcgactgaccacgcctgacaaactaagtaagatggggaaagcatgagcaccattgtgatttttttagctgctttgctggcctgctcactacttgcgggatggctgataaaagtgcgatccagacggcgtcagctgccctggaccaacgccttcgcggatgcgcaaacgcgtaaactcacacctgaagaacgtagcgccgttgaaaattatcttgagagcctgacgcaggtattacaggtgcctggcccaacgggagccagcgcggcaccgatctctctggcgctgaatgccgaaagcaacaacgtcatgatgctgacacacgctatcacgcgttacggcatctctaccgacgatccgaataaatggcgttactacctcgattcggtagaagtccacctgccccctttctgggaacagtacatcaacgatgagaataccgttgaactgattcataccgattcgctgccgctggttatttcactcaacggtcatacgctgcaggagtacatgcaggaaactcgcggctatgccttgcaacctgttccgtcaacgcaggcgtcgattcgcggggaagagagtgagcaaatcgagctactcaatattcgcaaagaaacgcatgaagaatatgcgctgagtcgtccgcgcgggctgcgtgaagcgttgctgatcgtcgcctccttcctgatgttctttttctgcctgattaccccggatgtatttgttccgtggctggcaggcggcgcgttactgctgctgggcgcaggtctgtgggggctattcgcgcccccggcaaaatcctccctgcgggaaattcattgtctgcgcggtacaccccgtcgttggggattgtttggcgaaaacgatcaggaacagatcaacaatatttcactcggtattatcgacctggtctatcccgcacactggcagccatacattgctcaggatctcggtcaacaaaccgatatcgatatctatctcgaccgccatgtagtgcgtcagggacgatatctttcgctgcatgatgaagtaaaaaactttccgttacagcactggctgcgcagtacgattatcgctgcgggctcgctgctggtgctgtttatgctgttattctggatcccgctggatatgccgctgaaattcactctctcatggatgaaaggcgcgcagaccattgaagccaccagcgtaaaacaactggctgacgctggcgtgcgggtaggcgatacattgcgtattagcggtacgggaatgtgtaatattcgcacttccggaacctggagcgcgaaaaccaattcaccttttttaccgtttgactgctcgcagatcatctggaacgacgcccgctcattaccattaccagaatctgaactggtcaacaaagcgacggcattgaccgaagcagttaatcgccagctgcaccctaaaccggaagatgaatctcgcgtcagtgcctcattacgttcagcgattcaaaaatccggcatggtattgcttgatgattttggcgacattgtactgaagacagcggatttatgttctgccaaagatgactgtgtgcgactgaaaaatgcgctggtcaatctcggcaacagtaaagactgggacgcgctggtaaaacgcgccaacaccgggaagctcgatggcgtgaatgtgttattacgcccggtgagtgcggaatcgctggataacctggtggcaacctccaccgcgccgtttatcacgcatgaaacggcgcgagcggcacaatcactaaacagtccggcccccggcggattcctgattgtcagcgacgaaggcagcgattttgttgatcagccctggccttcggcatcactttacgactacccgccgcaagaacagtggaacgctttccagaaactggcacaaatgctgatgcatacgccgtttaacgccgagggtatcgtcacaaaaatcttcactgacgccaatggtacgcagcatattggccttcatccgatcccggatcgttccggcctgtggcgctatctcagcaccacattgctgctactgacgatgctgggtagcgccatttacaatggcgtacaggcctggcgtcgttaccagcgtcatcgcactcgcatgatggagattcaggcctattatgaaagctgcctgaacccgcaactgatcaccccttcagaaagccttatcgaataacacgtttgcgcggcaggttatgctaccctgtcgcgcaaattgcttcactctggagatttccctcatgcatatcaacattgcctggcaggacgtagataccgttctgctggatatggacggcacgttgctcgacctcgccttcgataactatttctggcaaaagctggtgcctgaaacatggggcgcgaaaaacggggttacgccacaggaagcgatggaatatatgcgccagcaatatcacgacgtacagcatacgctaaactggtactgtcttgattactggagtgagcaactgggtctggatatctgtgcgatgaccaccgagatgggaccgcgtgccgtactgcgtgaagataccattccgtttcttgaggcactgaaagccagcggtaagcagcgaattttgctcaccaatgcgcatccgcacaacctgtcggtaaaacttgagcatacgggtctggacgcacaccttgatttattactttccacccacacatttggttatccgaaagaggatcagcggttatggcatgcagtggccgaagctacgggtctgaaagctgaaagaacgctgtttattgatgacagcgaagcgattctcgatgctgccgcgcaatttggtattcgttactgcctcggcgtgactaatcctgattccgggattgccgagaaacagtatcaacgccatccgtcactgaatgactaccgccgcctgatcccctcgctaatgtgaaggagacgccatgaaagaaaaacctgctgttgaggttcgactggataaatggctatgggctgcccgtttttataaaacccgcgcgctggcccgtgaaatgattgaaggcggtaaggtgcattacaacgggcagcgcagcaagccgagcaaaatcgtcgagctgaatgccacgctcactctgcgccagggaaatgacgaacgcacggtgattgtaaaggcgattactgaacagcgtcgccccgccagcgaggcagccttgctgtatgaagagactgcggaaagtgtagagaaacgcgaaaaaatggcgctggcacgtaaacttaatgccttaaccatgccgcacccggaccgacgcccggacaaaaaagagcgccgcgacctgttacgatttaaacacggcgacagtgaataactgtcacctgcaagagagatgattatgccgcaacatgaccaattacatcgctatctgtttgaaaactttgccgtgcgcggcgaactggtaaccgtttcggaaaccctgcaacagatccttgagaaccacgattatccgcagcccgttaaaaacgtgctggcagaactgctggttgcgaccagcctgttaaccgctacgctgaagtttgatggtgatatcaccgtacagctgcagggcgacggtccgatgaatctggcggttattaacggtaacaataaccagcagatgcgcggtgtggcgcgcgtgcagggcgaaattccagaaaatgccgacctgaaaacgctggtcggcaatggttacgtggtgatcaccattaccccgagcgaaggcgaacgctatcagggcgtagttggtctggaaggtgataccctggcggcctgcctggaagattactttatgcgttctgaacagctgccgacgcgcctgtttattcgcaccggcgacgtagacggcaaaccggctgcaggcggtatgttgttgcaggtaatgcctgcgcaaaatgcccagcaggacgactttgaccacctggcgacgctaaccgaaaccatcaaaaccgaagaactgctgaccttaccggcaaacgaagtgttgtggcgtttgtatcacgaagaagaggtgacggtttacgatccgcaggatgtggagttcaaatgcacctgctcgcgtgaacgttgcgccgatgcgctgaaaacgctgcctgatgaagaagttgatagcatcctggcggaagatggcgaaattgacatgcattgtgattactgcggtaaccactatctgttcaatgcgatggatattgctgaaatccgcaacaacgcgtctccggcagatccgcaagttcattaatgagtatgtccggcagagagggctctgccggattttacgactaatacacctgatgcgctttgtcactcattcagattcacattcagcctttcaccatccactacaagatcgcgccacgctttaggcttcgtccccagttttccatccttcgcagctgtgagtaatttttctttcgttatttcgttcggaagtaaactcatatcaagcgcgtcccattcttttctgtctgagtcaaagccatagacaatgactctgtcatcattaaaagcaaacaggatccgctccgcctgaccatcactattcagatcttgctcgaccaggacgcaggcgtctttttcaatacaggtcatcacgttatagcgatcctggattaaggccgaccagaatgtcgcatcaggtttaacagaaccaggggcaattaacacattatcggctaatactttttccgatacctgttgctgaagatgttgctctccatctaacgccatcagcagatcccgcgcgcgtttcgggtctttcataaacccggcatcgcttttcagcgactcaagcgcagcacgtccatagcgaccgctctgctcgagcatgtagatagttacctggtctgacgtgtttttgccgctctgataacgcgccatatggctgttcacgctaatgcgcatactgtccagcaccggcgaattaagaagcaccagtatcaccaacaccaataacgaaaccgcaaggttcactttgccctgaagaacaacgggattttgccctttacgccagacgatgctgacaaaataccccagcgaccacaccagtaacaccagcaccgccagcacgccctgcaagcggtcgacagtccagccgtactgagcgacccgcagccataacgcccaggcggcgacgaacacatacagcggagcaaccagcaaagcggttttaatcaggcaacgcaacggccctgtccagggaagtgacgctttttgcggatcgcggacaatagccattaagatcaattgcaaaaaggccagcgtcaacagcaacccggcggcggagatgtggcgagaaatcgcgctcaggcccgtaaacggcagggtgatgataaacatcagggttagcaatgatactaacggcagcaaccccgtggcgattaacgtgaacaacttttgaatagagtcgattaaacgtgactgtgttcgcgcgaggatcaccgccagcgcggtaaccagacctaacgtgagataaataaaccagtcggttgcaaaaaagagcgtattgaaaaacgtgatgccaacaagtttaaacaactcactccacagtaaaagcaccagccacgtcaagccattggcgagaaaaatcaccagtaatataagtacgttatgccatactgactggtaaaaatagcgatagcggctactgtcattgcggatgcgaaggctttgttgtatccacggtagcaacaacattgccatcaacagcagatagcaaccaaaatcccaaagcgccttttcagctctccaggggttcatgccatcagtttgccacttcagccagccgctcatccccagcgtggcaataaacactagcgccagccatccccaaaggcgcttctgtttaaaagagatcacggagaagagtaaaacggatgaaaacgcgacggtcgcaggcacgccataaacaatccaactgtgattttttccggaaagccaggcgatcagcaggtagcaaaccagaccctgaagtaatccggtagcaatcatcccccagcgtgttgcgggtgaaagttcaacgttatccatgttggttatccagaatcaaaaggtgggttaattatcgcatccgggcagtagtattttgcttttttcagaaaataatcaaaaaaagttagcgtggtgaatcgatactttaccggttgaatttgcatcaatttcattcaggaatgcgattccactcacaatattcccgccatataaaccaagatttaaccttttgagaacattttccacacctaaaatgctatttctgcgataatagcaaccgtttcgtgacaggaatcacggagttttttgtcaaatatgaatttctccagatacgtaaatctatgagccttgtcgcggttaacacccccaaaaagactttactattcaggcaatacatattggctaaggagcagtgaaatgcgcgttaacaatggtttgaccccgcaagaactcgaggcttatggtatcagtgacgtacatgatatcgtttacaacccaagctacgacctgctgtatcaggaagagctcgatccgagcctgacaggttatgagcgcggggtgttaactaatctgggtgccgttgccgtcgataccgggatcttcaccggtcgttcaccaaaagataagtatatcgtccgtgacgataccactcgcgatactttctggtgggcagacaaaggcaaaggtaagaacgacaacaaacctctctctccggaaacctggcagcatctgaaaggcctggtgaccaggcagctttccggcaaacgtctgttcgttgtcgacgctttctgtggtgcgaacccggatactcgtctttccgtccgtttcatcaccgaagtggcctggcaggcgcattttgtcaaaaacatgtttattcgcccgagcgatgaagaactggcaggtttcaaaccagactttatcgttatgaacggcgcgaagtgcactaacccgcagtggaaagaacagggtctcaactccgaaaacttcgtggcgtttaacctgaccgagcgcatgcagctgattggcggcacctggtacggcggcgaaatgaagaaagggatgttctcgatgatgaactacctgctgccgctgaaaggtatcgcttctatgcactgctccgccaacgttggtgagaaaggcgatgttgcggtgttcttcggcctttccggcaccggtaaaaccaccctttccaccgacccgaaacgtcgcctgattggcgatgacgaacacggctgggacgatgacggcgtgtttaacttcgaaggcggctgctacgcaaaaactatcaagctgtcgaaagaagcggaacctgaaatctacaacgctatccgtcgtgatgcgttgctggaaaacgtcaccgtgcgtgaagatggcactatcgactttgatgatggttcaaaaaccgagaacacccgcgtttcttatccgatctatcacatcgataacattgttaagccggtttccaaagcgggccacgcgactaaggttatcttcctgactgctgatgctttcggcgtgttgccgccggtttctcgcctgactgccgatcaaacccagtatcacttcctctctggcttcaccgccaaactggccggtactgagcgtggcatcaccgaaccgacgccaaccttctccgcttgcttcggcgcggcattcctgtcgctgcacccgactcagtacgcagaagtgctggtgaaacgtatgcaggcggcgggcgcgcaggcttatctggttaacactggctggaacggcactggcaaacgtatctcgattaaagatacccgcgccattatcgacgccatcctcaacggttcgctggataatgcagaaaccttcactctgccgatgtttaacctggcgatcccaaccgaactgccgggcgtagacacgaagattctcgatccgcgtaacacctacgcttctccggaacagtggcaggaaaaagccgaaaccctggcgaaactgtttatcgacaacttcgataaatacaccgacacccctgcgggtgccgcgctggtagcggctggtccgaaactgtaatgatttgaagctggagaatatctatccagtatcttatagaaagcaaaacgggaggcaccttcgcctcccgtttatttacccttcttttgtcgtgccctgcgcccgcgttaccggcactggcagccaggcgcgaatggaaagcccgccccgctcgctggtgccaagctccagcatcccgttatggttatccacgatacgctgcacaattgccagccctaatcccgtgccgctaatggtgcgcgcactgtcgccgcggacaaacggctggaacaggtgcttacgttgttccggcgcaattcccggaccgtcatcttccacctggaaccaggcgcgattcggctccgttccgctgctgactttgatccagccattgccataacgggcggcgttgaccaccatattcgccaccgcgcgtttgatcgacagcgggtgcattttcacttcaatgctgccggggtaaagcgcggtttcaatttcccgctcatagccactttcggcagcaatcacctcaccgagtactgcattaagatccgccatttccatcggcatctcctgcccggtgcgcaggtagtcgataaactgctcaatgatggcgttgcactcttcgatatctttattgatcgattctgccagatagccatcctgctcgctcatcatctcagtcgccaggcgaatacgcgtcagcggcgtgcgcaagtcgtgacttacccccgccatcagcagcgtgcggtcatccgccagttgcttaacaccagccgccatatggttaaaggcacgggtaacggaacgcacctcggacgcgccatactcacgcagcggcggcggaataatccctttaccaacctgcaaggctgcgtgttcgagatcgaccaacggtcggttctggatacgaataaacagccacgccccgcctatcgccaatagcataatcgccagcgtatagcggaacagcggagagaaatcgccctgatgaatttcggtcagcggcacgcgtacccagatattgggcgacagccaggttttcagccagacgacaggcgaacttttgttgacctcaacgcgcacttccgtcgggccgcccagttgctgcgccatctgatggcttaagaattcatagtgttgcgcccaacgcagacctgcctcttcggcagcctcgttggagtagagagagatccccagctcacggtagatctcccgacggaaagcgggaggcacaaccaactgcgtgccgtcctccagttgcagtttgtcggtcatcaacatacgcacttcgtacgcgaggactttattaaactgctggaggctcggcaaaatcgcgaagttcagcaccaccagataagtcgtcaccaggctggcgaacagcaaggtgacgatgagcaataacgtacgggcaaatgaacttcgtggcgagaagcgcaatcgcctcatgctttagagccgtccggtacaaagacgtagcccagaccccagacggtctgaatgtaacgcggatgcgctggatcttcttccaccatgcggcgcagacgcgaaatctgcacgtcgatggagcgttccattgcggaatattcacgaccacgggcaaggttcatcagcttatcgcgggagagcggctcacgcggatggctgaccagtgccttcagtaccgcaaactcaccgctggtgagcggcatcggctcgtcttcgcggaacatttcgcgcgtaccgaggttaagtttgaacttaccgaaagcaattaccgcctcttcctgtgacggtgcgcctggcagttcgttcgcctgacgacgcagcaccgcacggatacgggccagcagttcacgcgggttaaacggttttggaatgtagtcgtcagcgccaatctccaggcctacgatacggtccacttcttcccctttcgccgtcaccataatgatcggcatcgggttgctctgactacgaagacgtcggcaaatcgacaagccatcttcaccaggtaacattaaatccagtaccataagatggaaagattcacgagtcagcaggcgatccatctgttctgcattagcgacgcttcgaacctggaagccttgttcggtgagataacgttccagcagcgcacgcaggcgcatgtcgtcatcgaccaccagaatcttgtagttctcttgcattgtttgtactcccaaaggttcgcaacaatttgtaagcgtgtattcttaaaaaagctcacgttcgtcaccagctaaatctggtatgaatttcagcctaaattgttacaaagcatattaaacagcagtttaagtatacaatttattcggcgaaacattattgattctgttgatatgatcacgttatacccaatgtgcgcattatcaaacagacaaagggaatcaacgagatgaaaacgcccctggttacccgggaagggtatgaaaaactcaaacaagagcttaattatctctggcgtgaagaacgcccggaggtcacaaaaaaggtgacctgggccgcaagtctgggcgaccgcagcgaaaatgctgactatcagtataataaaaagcgtctgcgtgaaatcgaccgtcgcgtgcgctatctcactaaatgcctggaaaatctcaaaatcgtcgattactcccctcagcaggaaggcaaagtcttttttggcgcgtgggtggagattgaaaacgacgatggcgtgactcaccgtttccgtattgtcggctacgatgaaatttttggccgtaaagattacatctctatcgattccccgatggcccgcgcattgctgaaaaaagaagtcggcgatctggcggtggtgaatacccctgccggggaagcgagctggtatgttaatgctatcgagtacgtgaaaccgtaaggaagagtcttaacctcctgccgatggctggcatttttgccagccagtccgtataactatcccctgatttttgatccgaaaagatgaactcaaaccatgatgaatgattcgttctgccgcattattgcgggtgaaattcaggcgcgcccggaacaggttgacgctgccgttcgcctgcttgacgaagggaataccgtgccgtttatcgcacgttatcgtaaggaaatcaccggcggtctggatgacacgcagctgcgtaatctggaaacgcgtctgagctatctgcgcgagctggaagagagacgtcaggcgatcctcaagtccatttccgagcaaggcaaactcaccgatgatctggcgaaggccatcaacgccaccctaagcaaaaccgaactcgaagacctctacctgccctacaaacctaaacgccgcacccgcgggcaaatcgccattgaagcagggcttgagccgttggctgacctgctgtggagcgatccgtcacacacgccagaagtcgccgctgcacaatatgttgatgccgataaaggcgtggcagataccaaagccgcgctggatggcgcgcgctatatcctgatggaacggtttgccgaagatgccgcgctgctggcgaaagtgcgtgattatctgtggaagaacgcgcatttggtttctacggtggtgagcggtaaagaagaggaaggggcgaaattccgcgactatttcgatcatcacgaaccgttgtccacggtgccttctcaccgcgcgctggcgatgttccgtgggcgtaacgaaggcgtactccagctttcgctgaatgccgatccgcagttcgatgagccgcccaaagagagctattgcgagcaaatcatcatggatcaccttggcctacgcctgaacaatgccccggcggatagctggcgcaaaggcgtagtgagctggacctggcgcatcaaggtgctgatgcatctggaaaccgaactgatgggtaccgtgcgcgaacgcgcggaagatgaagcaatcaacgtctttgcccgtaacctgcacgatctgctgatggcggcccctgccggactgcgtgcaacgatgggcctcgatccgggtctgcgtactggggtaaaagtggcggtggtcgatgccactggcaaactggtagcgaccgataccatttacccgcacaccggacaagccgcaaaagcagcgatgaccgttgctgccttgtgtgaaaaacataacgttgaactggtggcgatcggcaacggtacagcttcccgcgaaactgaacgtttctatctcgacgtgcagaagcagttcccgaaagtgaccgcacagaaagtgatcgtcagcgaagctggcgcgtcggtttactcagcttccgagctggcagcgcaggagttcccggatctcgacgtttcgctgcgtggcgcggtgtctatcgcccgccgtttgcaggatccgctggcggagctggtgaaaatcgatccgaaatctatcggcgtaggtcagtatcagcatgacgtcagccagacgcaactggcccgcaaactggacgcagtagtagaagactgcgtaaacgccgttggcgtcgatctcaacactgcttctgttccgctgttaacccgcgtggcgggcctgacgcgcatgatggcgcaaaacatcgtggcctggcgcgatgagaacggccagttccagaaccgtcagcaactgctgaaagtcagccgtctggggccgaaagccttcgagcagtgcgcgggcttcttgcgcattaaccacggtgataacccgctggatgcttctaccgtccacccggaagcctatccggtggtggaacgcattctggcagcaacacagcaggcactgaaagatctgatgggtaacagcagcgaactgcgtaacctgaaagcgtctgactttactgatgaaaaattcggtgtgccgacagtaactgacatcatcaaagagctggaaaaaccgggtcgcgatccgcgtccggaatttaaaaccgctcagtttgccgatggcgtcgagacaatgaacgacctgcaaccgggtatgatcctcgaaggtgcggtgaccaacgtcaccaactttggcgcgtttgtcgatatcggcgtgcatcaggacggcctggttcacatctcttcattgtcgaacaagtttgtggaagatccgcataccgtggtgaaagcgggcgacattgtgaaggtgaaagtgctggaagtggatcttcagcgtaaacgtatcgccctgactatgcgtctggacgagcagcctggcgaaaccaacgcccgtcgcggcggcggtaatgaacgcccgcaaaacaaccgcccggcagccaaaccacgcggtcgtgaagcgcagcctgccggtaatagcgcgatgatggatgcgctggcggcggcaatgggcaaaaaacgttaaacgcccggactggcccctaaacctgcgcgataaggcgttcacgccgcatctggcaacgaacgccttgcctgacataaaagtgccggagaatatctccggcctttttattccacaaccaaactcataatatattccggcaatatttatcacttcattaacaactgaaaccttaattaaacattagccagtccgggtaattcactattcgaattatattttcgctgcgatataaccttgagccacatcaacattgagtcagattattattcaaaccaacattcgcacacattttaagtattgctgatagaaaccattctcattatcattgtgttgttgattatttaatctctcctttgttggcaaatcatctggtctcatgtcgctgtcaaacgccccatgaggtagttatccagttaatgagaaacaagtaggcacctatgcaatacactccagatactgcgtggaaaatcactggcttttcccgtgaaatcagcccggcatatcgccaaaaactgctttctcttggcatgttacctggctcctcttttaatgtggtgcgcgtcgctccactcggcgaccccattcatatcgaaacccgtcgtgtgagcctggtattacgcaaaaaagatctggccttattagaagtggaagcggtttcctgttaatacggtgataacaacaatgaaaaaattaaccataggcttaattggtaatccaaattctggcaagacaaccttatttaaccagctcactggcgcacgtcagcgtgtaggtaactgggctggcgttaccgtcgaacgtaaagaagggcaattctccaccaccgatcatcaggtcacgctggtggacctgcccggcacctattctctgaccaccatctcatcgcagacctcgctcgatgagcaaatcgcctgtcactacattttgagtggcgacgccgacctgctgattaacgtggtggatgcgtctaaccttgagcgtaacctgtacctgacgctacaactgctggaactcggcattccctgcattgtggcactgaacatgctcgacattgccgagaagcaaaatattcgtattgaaattgatgctctgtcggcgcgtctgggctgtccggtgatcccgctggtttcaacccgtggtcgcggtattgaagcgctcaagctggcgattgatcgctataaagctaacgagaatgtggaactggtacattacgcacagccgctactcaacgaagcagattcactggcaaaagtgatgccttccgacatcccgctgaaacaacgtcgctggctgggcctgcaaatgctggaaggcgatatctacagccgcgcctacgccggtgaagcgtcgcagcatcttgatgccgccctcgcccgtctgcgtaatgagatggacgatccggcgctgcacattgccgatgcgcgttaccagtgcattgctgccatctgtgatgtggtaagcaacaccctgacggcagaacccagccgtttcaccactgcggtagataaaatcgtgctcaaccgtttcctcggtctgccgattttcctctttgtgatgtacctgatgttcctgctggctatcaacatcggcggggcgttacagccgctgtttgatgtcggctccgtggcgctatttgtgcatggtattcaatggattggctacacgctccacttcccggactggctgactatcttcctcgcccagggcctgggtggcggtattaacaccgtgctgccactggtgccgcagattggcatgatgtacctgttcctctccttccttgaggactccggctatatggcgcgtgcggcgtttgtgatggaccgcctgatgcaggcgctgggcttgcctgggaaatcctttgtgccgctgatcgtcggtttcggttgtaacgtaccgtcggtaatgggcgcacgtacgcttgatgcaccgcgtgaacgtctgatgaccatcatgatggcaccgtttatgtcctgcggcgcgcgtctggctatcttcgcagtattcgcggctgccttcttcgggcagaacggtgccctggcggttttctcgctgtatatgctgggtatcgtgatggcggtgctgactggcctgatgctcaagtacaccatcatgcgcggtgaagcgacgccgtttgtcatggagctgccggtctaccatgtaccacacgttaaaagcctgattatccagacctggcagcgtctgaaaggcttcgttctgcgtgctggtaaagtgattatcatcgtcagcattttcctgagcgccttcaacagcttctcgctgagcggaaaaatcgtcgataacatcaacgactcggcgctggcttccgtcagccgggtgatcaccccagtcttcaagccgattggcgtgcatgaagataactggcaggcaacggttggcctgtttacaggtgcaatggcgaaagaagtggtggtgggcacgctcaacaccctctacaccgcagaaaatattcaggacgaagagttcaatccggcagaatttaacctcggtgaagagctgttcagcgcggtagatgaaacctggcagagcctgaaagacaccttcagccttagcgtactgatgaatcccattgaagcgagcaaaggcgacggcgaaatgggtaccggggcgatgggcgtgatggatcagaaattcggtagcgcagctgccgcatacagctacctgattttcgtcctgctgtatgtaccatgtatctcggtgatgggagccatcgcccgtgaatcaagccgtggctggatgggcttctccatcctgtgggggctgaatatcgcttactcactggcaacattgttctatcaggtcgccagctacagtcagcacccaacttacagcctggtgtgcattctggcggtaatcctgtttaacatcgtagttatcggtctgctgcgccgcgcgcgtagccgggtggatatcgaactgctggcaacccgcaagtcggtaagcagttgctgcgcagccagcaccaccggtgattgccattaatggcttcacttattcaggtacgtgatttgctggcgttacggggccgtatggaagcgacccagataagccagacattgaacactccgcagccaatgattaacgccatgctgcaacagctggaaagcatgggcaaagccgtgcggattcaggaagaacctgacggctgcctctctggcagttgtaaaagctgcccggaaggcaaagcctgtctgcgcgagtggtgggcgctgcgttaaccatactccatcgcctgttttgaaaagcccggtatgcgtttgcatccgggcttttttgcgtgcggctttccataaaaatgcaattcttgcagcgcgacgtaagttcctctgaaagcgtctcgcagggatgaaaactggctaatgcacagatgtggagtggcgcgtagagtcgcggcattcaaacaacaggtgaaggaacgccatgagtaaaaagcagagttccaccccacatgatgcgctgttcaaactctttttacgccaaccggagacggcacgcgattttcttgcgtttcatttaccggcacccattcacgcgctctgtgatatgaaaaccctcaagctggagtcgagcagctttattgatgacgatctgcgtgaaagctattccgatgtgctgtggtcggtgaaaacggaacaaggaccaggatacatctattgtctgattgaacatcaaagcacctcaaacaaactgatcgcatttcgcatgatgcgttacgctattgccgcaatgcaaaatcaccttgatgctggatacaaaacgttgccgatggtggtgccattgttgttttaccacggtattgaaagcccctatccctattcgctgtgttggctggattgtttcgccgatcccaaactggcaaggcaactttatgcctccgcatttccgctgattgatgtcaccgtcatgcctgatgatgaaatcatgcagcaccgacgtatggcgctgctggagttaattcaaaaacatattcgtcaacgcgatctgatggggctggtagagcaaatggcctgcttattaagtagtggatacgctaatgacagacaaatcaaagggctgtttaattacatactgcaaactggcgacgctgtacgttttaacgattttatcgacggcgttgccgaacgttcaccgaaacacaaggagagtttaatgactattgcggaaagattgcggcaggagggggaacaatccaaagccctgcatatagccaaaataatgcttgaatccggagtccctcttacagacatcatgcgctttaccggggtgtcagaagaagagttggctgcggcgagccagtaaatttctgtctcgccatttcaaaagttgcctacaccctctgcttcaacgccaccagcaggtgacaaaactcgaccggatgcgaaataaacggcgcatgggccgctttggcgaagatatatgattcgctgtgaggccaaagtttatccagcatcggcaccactttgcgcggcaccagaccgtcgagatagccatacaatcgcaaaaacggcatggacacgttttgcagcggctgacggagatcgaccgttttcaggatttccagcccgccattaagcacgtcaacctccggcatcggtaacgccagaacggttttcttcaacgcccgcgcatcctggcgcgccgtttcagtccccatggtttgtaacgccaggaaccgctccactgtacgctgaaaatcatcactgagttgctgctgaaatcccgccagcacgtccggttttatccccggccactcgtcacgagcactaaaacaaggtgacgacgccacggtgaccagcgcctgaacacgctcgggatgggttaacgcaatctggcttgccaccagcccgcccagactccagcctaaccaaatggctttatcaggtgcctgttgcagcacggcttcggccatatcagcaagtgacagcgcaccaaatccccggctacgcccgaagccgggcaggtcaacaaggtgcagcgtaaaatgcgagctaagttcctcgtcaatgcaacgccacacttcggcattcagtccccatccgtgcagcagcacaagatgaacattcccctgacctttggtctgccaccagatgttattcatccgctattgttctcttttgacttacaaggatgaacatatgctaacagtaccgggattatgctggctatgccgaatgccactggcgttaggtcattgggggatttgttcggtctgttcacgcgccacccgcacagataaaacgttatgcccacaatgtggattacccgccacacactcccatcttccctgcggtcgctgcctgcaaaaaccgccgccctggcaaagactggtcacagttgccgactatgcgccgccgttaagtctgctcatccaccagcttaaattttcccggcgcagtgaaatcgccagcgccctgtcacgtctgttactattggaagtcttgcacgctcgtcgcaccaccgggttgcaattgccggatcgcatcatcagcgttccgttatggcagcggcgtcactggcgtcggggatttaatcagagcgatttgctgtgtcagccgttatcacgctggttgcactgccaatgggatagcgaagccgtcacacgtacacgggccactgcgacccagcattttctcagtgcccggctgcgcaagcgcaacctgaaaaatgcctttcgtcttgaattgcccgtgcaaggtcgccatatggtgattgtggatgatgtcgttaccaccggaagtaccgtcgcagagattgcgcagttgcttttacgcaatggtgcggcgactgtccaggtctggtgcctttgtcgaaccttgtagagcctcgatgatgggcgtattataaccaactaaaatagtcaactattaggccattactatgatccgtatttccgatgctgcacaagcgcactttgccaaactgctggcaaatcaggaagaagggacacaaatccgcgtatttgtgattaaccctggcacgcctaacgctgaatgtggtgtttcttattgtccgccggatgccgtggaagccaccgacactgccctgaaatttgacctgctgaccgcgtatgttgatgagttaagcgcaccatacctggaagatgcagagatcgactttgttaccgaccagttgggttctcagttaacgctgaaagcgcctaacgccaaaatgcgtaaagtggcagacgatgcaccgctgatggagcgcgtggagtatatgctgcagtcgcagatcaacccacagcttgctggtcacggtggtcgcgtttcgctgatggaaatcaccgaagacggttacgccattctgcaatttggcggcggctgtaacggttgttccatggtggatgtgacgctgaaagaagggatcgagaagcagctgctaaacgaattcccggagctgaaaggtgtgcgcgatctcaccgaacaccagcgcggcgaacactcctactactaagttatcccctcttttgtagattgcccgatgcgacgctaaagcgtcatttcgggcctacattgaacatgtgccagacgttggcgcagcattgctttggcaaatccctcccttcgtttccccgcgataatatgaccaacctctcataatttaaatttaccccgctctggtgattctcaaacgccagatgttacccgtatcattcacatgggtaccaaacatactcctgacatctgactacaataattagttttagtgggtatcagtcgtggtgccgcaatatctctgttcccgattgggataattagagtttgtcgtcagaaaattgacgttacccataacaaatgaaaggccaggtaaatcatgccattagtcattgttgctatcggtgtaatcttgttgttgctcctgatgatccgcttcaaaatgaacggcttcatcgctctcgtcctcgtggcgcttgctgttggattaatgcaaggaatgccgctggataaagttattggctccatcaaagccggtgtcggcgggacgctcggtagccttgccctgatcatgggttttggcgcaatgctgggcaaaatgctggcagactgcggtggcgcacaacgtatcgccaccacgctgattgccaaatttggtaaaaaacacatccagtgggcggtggtactgaccggttttaccgttggttttgccctgttctatgaagtgggctttgtgctgatgctgccgctggtgtttaccatcgcggcttctgcgaatattccactgctgtatgttggtgtaccaatggcagctgcactgtctgtgacccacggcttcctgccaccgcatccgggtccgactgcgattgccaccattttcaatgccgatatgggtaaaaccctgctgtacggtactattctggcaatcccgaccgtgattctcgccggtccggtttacgctcgcgtgttgaaaggtatcgataagccaattccggaaggtctgtacagcgcgaaaaccttcagcgaagaagagatgccgagctttggcgtcagcgtctggacctctctggtgccggtagtactgatggcgatgcgtgcgattgccgaaatgatcctgccgaaaggtcacgctttcctgccggtagcggagttcctcggtgacccggtaatggcaacgctgattgccgtgctgattgcgatgttcacctttggtctaaaccgtggtcgttcaatggatcagattaacgacacgctggtttcttccatcaaaatcattgcgatgatgctgttgatcatcggtggtggcggtgcgttcaagcaggtgctggtagacagcggcgtggacaaatacattgcttccatgatgcacgaaaccaacatttctccgctgctgatggcctggtcgattgctgccgtactgcgtatcgcgctgggttccgcaaccgttgcggcaatcactgcgggtggtatcgcggcaccgctgattgcaacgacgggtgttagcccggagctgatggttattgcggttggttccggtagtgtgattttctctcatgtgaacgatccgggcttctggctgttcaaagagtactttaacctgactatcggcgagaccatcaaatcctggtcgatgctggaaaccattatctcggtgtgcggtctggtaggctgtctgctgctgaatatggtgatttgataacactgactgccggatgcatcgcatccggcatcaaccgcactctacttcttcttcgctgcagctctgcgccgtctgtccaaatccttcagcaacttgttcacgccatcatcggcaaacatcgtctcaagcgttgcggagagcttgcgccgccagtttttatactggtaactggtgccaggaatattcaccggttcggccatatccagccagtcttccggctgtagtcctaacagagcactgttactgtcggcaatgtagcgctgcaaaccacgattaagcgtcggcgtcatcgacatcaacgatgccttatgcccggcacgttttggcagacaaccatatttatgcagtgcatccagcagcccttgcttcgccagttcgcgatcctgatacagaccgcgcagtaccacttcatccggatacagccccagggttttgcccagcgttagatccccgctctcccagtagccgcgtagcgtaggcaggtcatgtgtcgccgcaaccgccatcgactgctccggatacgctttcggtgcacggaacgtcttctcgtggtcgttttcgaaatagagcactttgtaggagtacacaccgctgctgcgcagcttaccgacaatctctaccggtacggtaccgagatcttcaccaatcaccatacagcgatgacgtttactttcgagtgccagaatcgaaagcagatcatccaccggatagtgaacatacgcgccctgatctgccgtctcgccatacggtatccaccacaaacgcagcatcgacatcacatggtcaattcgtaatgcgccgcagttttgcatattggcacgcaacagctcgataaacggttcataggcacgcgcggtaataatatgcgggtccattggcggtaatccccagttctgccccaacgggccgaggatatccggcggcgcgccaaccgacgctttcaggcaatacagttcacggtcacaccaggtttccgccccaccttccgctacgccaaccgccagatcacgatacaagccaatcggcatttcatagccctggcttatctcccagcaggcggcaaactggctgtaagccagccactgcaaccagagataaaaatcaacgtcatcacgatgttcttcgcagaactgacgcacttctggtgaatccacgttctgatacatctctggccatgcaggccagccccagcgcatttcgtcctctttcacttgctgggcatgtagcgcatcaaaggctgcctgccagaacaggctgtcgccttgatctgcaacaaactggcgaaacgcggccatctgctcatcatcacgttgcgcgaaacctttccacgccattcgtaatgctgtcatttttagggcggtaaccgtggagtaatcgacccagtcggcatcgcgcgcctgttgcagcgtctgttgcgtggtcggcaactgccaccaggcctgagcctcttcgctaagatggaaatcttcaacggcgttaacgtcgatataaatcacattcagccaacggcgagaagacgggctgtatgggctggcactctccggatttgccggatagagcgcatgaatcgggttcaggccgatgaacgacccgccacgttttgccacatccaccagcatcgctttgagatcgccaaaatccccaataccccagtttttttccgatcgcagcgtataaagctggacgcaggcaccccacagcttttgtttattcagcaacgcctgcggttcgtaacagcgcttcggggcgacaatcacccggcaatgcgcgcgctggtcgtcctgggtgagtgtcagcgtgtgataaccttccggcagcttcgtcggtagattgaacgctttgccccccgttacatggcctttgtactgtgttccttcttcggtggtcagcagccagctatattcgccgctgccctccaccaccatcggcatttttttgccgctggtataaaccatgacattcgggactggcgttaccgccactttcgtggcggtacgttgatgcatcgcgtcaagcaaacgccgtttggtttcggcgctaatcgactgcggtttaccgtgggcattgatgtaattggggctaatccccgccgccagcgcggcattatccagacgtttgctttccatcgagcttccttagcgttttgcctgccagatacgagcctgataatcgcgaatagagcgatccgagctaaacataccgcagcgggcggtattgaggatcgccgcgcgagtccaggcctcctggtcgcggtacagcacatccacctgcttttgtgcctcaacataggctgcgaaatccgccatcaccagatacggatcgccgccttgtttgccgatactgtgcagcatctggtcgaaggcatgcttatcgccgtcgctgtatttaccgctttccagctctttcaatactgcgtccagcaccttatctttcttccgccatttcaccgggtcgtagcctttggccagaattgccttcacttgttccacggtatgaccaaaaataaagatattttcttcaccgactttctcggcgatttcaacgttcgcaccatccagcgtaccgacagtaagcgcaccattgagcgccagtttcatattgccggtaccggaagcttctttacctgcagtcgaaatttgttcggagatatccgccgccgggatcagtttttccgccgccgaaacgcaataatccggcaggaacaccaccttcaacttatcgccaaccagcggatcgttgttgatcacgtcagccactttgttgatcgcaaagataatattcttcgccaggtagtagcccggtgctgctttcgcgccgaagaggaagacgcgcggtacgcgatcagcctgcgggttttcacgaatttctttgtacaacgccagaatatgcagcagattcaggtgctggcgtttgtactcatgcagacgtttgatctgaatatcgaaaatcgcctgtggattgatctcaataccggtacgaactttcacaaactccgccagacggactttattcgcctgcttgatctcgcgatattgctgacggaatttcgcatcatcagcgaatttttccagattgatcagctgatcgagatcgttagcccactcttttttcagtgatttatccaacagagccgccagtgccgggttgcactgtttgatccagcgacgtggggtaataccgttggtgacgttatggaatttgttcggccatagctggtgatattccgggaacagatctttcaccaccagatccgagtgcagcgccgcaacaccgttcaccgcgaaaccgccaaccacacacaggttcgccatatgcacttgtttgtcgtgcaccaccgccagtttggcccacactttttcatcgcccggccaggttttctccaccagcgttttaaagcgagtattaatttcgttaataatctgcatgtggcgcggcagtaagcctttcaccagtttcacatcccagcgttccagcgcttctggcatcagggtatggttggtgtaagcgaaagttttgctggtaatggcccaggcgtcatcccagctcatctggtgctcatcgatcagcacgcgcagcagttctggaatcgcgatagttgggtgggtatcgttcagctgaataacttcgtaatccgccagttcgtgcagtttacgccccgccagatgatggcgacgcaaaatatccgctaccgaacaggcacactggaagtactgctgcatcaagcgcagctttttaccggcagtatggttgtcgtttggatagagaactttggtcagtttttccgcattgatgccctgctgttcggcacgcaggaaatcaccgtcgttaaatttagtcagatcaaacggatgcgcgtgcgtcgcctgccacagacgcagcggctgcgccacgccattacgatagccgacaacggggagatcccacgcttgaccggtaatggtaaactccggctcccagcgtccgtctttcgtcactttaccgccaatccctacctgcacatccagtgcttcgttgtggcggaaccacgggtagttactgcgatgccagtcatccggcgcttcaacctgtttgccatcgacaaaagactggcggaacaaaccatattgatagttcagaccgtaacccgtcgcagactgaccgacagttgccattgagtcgaggaagcacgccgccagacgtcccagaccaccgttacccagcgccgggtcgatctcttcttccagcaggtcagtcagattgatgtcataagccttcaacgaatcctgtacatcctgataccagccgagattcaacaggttgttgcccgtcagacgaccaatcaaaaactccattgagatgtagttaacatgtcgctgattcgccaccggtttggcgaatggctgagcacgcagcatttcggccagtgcttcactcactgccagccaccactggcgaggagtcatttcagccgcagaatttaagccataacgctgccactgacgtgaaagcgcttcctgaaattgcttatcgttaaaaataggttgtgacataggagttccacttttcttagattttcaacacaacgttatcgctagtttgccaggctcgatgttgaccttcctcatcctgcgggggattaggcagggaggagttgcggggatgagcaaggaaatgtgatctcaaccacttaaagctagtgcaaaccacaggattagcagcaaatcaatgcaatacagcgcagaaaatctgtatctaagtgcaaaaaatggccgttgcgtattttcaaaaagcggaaggtaactctataaattaagtaaaggagtgaaacagtttcataagtaaaatatccagtgtgctccatctcattcttaatagatttattaagatcatctttttagatggcactttcatcaggaatgaagaagaaacccttgcttaaatgaatctgatgaacataagggaaaccagtattcacgctggatcagcgtcgttttaggtgagttgttaataaagatttggaattgtgacacagtgcaaattcagacacataaaaaaacgtcatcgcttgcattagaaaggtttctggccgaccttataaccattaattacgaagcgcaaaaaaaataatatttcctcattttccacagtgaagtgattaactatgctgattccgtcaaaactcagtcgtccggttcgactcgaccataccgtggttcgtgagcgcctgctggctaaactttccggcgcgaacaacttccggctggcgctgatcacgagtcctgcgggctacggaaagaccaccctcatttcccagtgggcggcaggcaaaaacgatatcggctggtactcgctggatgaaggtgataaccagcaagagcgtttcgccagctatctcattgccgccgtgcagcaggcaaccaacggtcactgtgcgatatgtgagacgatggcgcaaaaacggcaatatgccagcctgacgtcactcttcgcccagcttttcattgagctggcggaatggcatagcccactttatctggtcatcgatgactatcatctgatcactaatccagtgatccacgagtcaatgcgcttctttattcgccatcaaccagaaaatctcaccctggtggtgttgtcacgcaaccttccgcaactgggcattgccaatctgcgtgttcgtgatcaactgctggaaattggcagtcagcaactggcatttacccatcaggaagcgaagcagttttttgattgccgtctgtcatcgccgattgaagccgcagaaagcagtcggatttgcgatgacgtttccggttgggcgacggcactacagctaatcgccctctccgcccggcagaatacccactcagcccataagtcggcacgccgcctggcgggaatcaatgccagccatctttcggattatctggtcgatgaggttttggataacgtcgatctcgcaacgcgccattttctgttgaaaagcgccattttgcgctcaatgaacgatgcactcatcacccgtgtgaccggcgaagaaaacgggcaaatgcgcctcgaagagattgagcgtcaggggctgtttttacagcggatggatgataccggcgagtggttctgctatcacccgctgtttggtaacttcctgcgccagcgctgccagtgggaactggcggcggagctgccggaaatccaccgtgccgccgcagaaagctggatggcccagggatttcccagcgaagcgattcatcatgcgctggcggcaggcgatgcgctgatgctgcgcgatattctgcttaatcacgcctggagtctgttcaaccatagcgaactgtcgctgctggaagagtcgcttaaggccctgccgtgggacagcttgctggaaaatccgcagttggtgttattgcaggcgtggctgatgcaaagccaacatcgctacggcgaagttaacaccctgctagcccgtgctgaacatgaaatcaaggacatcagagaagacaccatgcacgcagaatttaacgctctgcgcgcccaggtggcgattaacgatggtaatccggatgaagcggaacggctggcaaaactggcactggaagagctgccgccgggctggttctatagccgcattgtggcaacctcggtgctgggtgaagtgctgcactgcaaaggcgaattgacccgctcactggcgctaatgcagcaaaccgaacagatggcacgccagcacgatgtctggcactacgctttgtggagtttaatccagcaaagtgaaattctgtttgcccaagggttcctgcaaaccgcgtgggaaacgcaggaaaaagcattccagctgatcaacgagcagcatctggaacagctgccaatgcatgagtttctggtgcgcatccgagcacaactgttatgggcctgggcgcggctggatgaagccgaagcgtcggcgcgtagcgggattgaagtcttgtcgtcttatcagccacagcaacagcttcagtgcctggcaatgttgattcaatgctcgctggcccgtggtgatttagataacgcccgtagccagctgaaccgtctggaaaatctgctggggaatggcaaatatcacagcgactggatctctaacgccaacaaagtccgggtgatttactggcaaatgaccggtgataaagccgccgctgccaactggttgcgtcatacggctaaaccggagtttgcgaacaaccacttcctgcaaggtcaatggcgcaacattgcccgtgcacaaatcttgctgggcgagtttgaacctgcggaaattgttctcgaagaactcaatgaaaatgcccggagtctgcggttgatgagcgatctcaaccgtaacctgttgctgcttaatcaactgtactggcaggccggacgtaaaagtgacgcccagcgcgtgttgctggacgcattaaaactggcgaatcgcaccggatttatcagccattttgtcatcgaaggcgaagcgatggcgcaacaactgcgtcagctgattcagcttaatacgctgccggaactggaacagcatcgcgcgcagcgtattctgcgagaaatcaatcaacatcatcggcataaattcgcccatttcgatgagaatttcgttgaacgtctgctaaatcatcctgaagtacctgaactgatccgcaccagcccgctgacgcaacgtgaatggcaggtactggggctgatctactctggttacagcaatgagcaaattgccggagaactggaagtcgcggcaaccaccatcaaaacgcatatccgcaatctgtatcagaaactcggcgtggcccatcgccaggatgcggtacaacacgcccagcaattgctgaagatgatggggtacggcgtgtaagtttagccggataacgcgccagatccggcttacatctctgcatcattcaatgctcacccgcgttacgccatctgtttctatcaaactaaaccgcaccggcaagaaacgctccaccaccgcgatattggtcagcagatggcatgagggatgggcgaccgtaaattcccccgcgcccgccagcgccatcggtagcaccagttggtcagcaagatattcccccaccgccgccgtgcttgccaggtagcgtttcacctctttcaccaactgtgccgcaaccacctcggcactgacgcgcttttcaccgacgacaaaaaagcgttcggtgatattttcactttcgacttcaagcgagacggtattacccggcccctggtcgcgcggcaggttatgaatattctgttcatgcagggaaaaactccccgccagtgtagcgatttcacgctcagcaacatggcgcggcacaccagctaatagaacttctccacgcatctgcacaatgttcccgcgctcgccaagttgcaaggtgttaaacgatgccacgggcgagacttccgttgccaccacaccgcctccggcagggtaaaaaccgtggcgtaacagcgtggtttgctgatgaattcccattttcgccagcagcggctccagcacccggcggataaaatccgcaggtggcgccgacgggttatcggtaccgccgctcacttcaacacgcgaaggtccatcggcaaaccacagcgcgggcagcacagtttgcagcaccagcgtacaacttccggcgctaccgatagcaaagcggtaatcgccgccccgcacggtgccaggccggaagagcagacgctgcgatcccagctccgcaccttccaccgttgccctacaaatttccgcagccgcttttaccgcggtcagatgctggcgcagcagccccggtttcgcccgtccggctcgaatgccagtgatggtaaatggctggccggttatcatcgacaggctcagcgccgagcgcaggatctgtccgccgccttcgccctgtgcgccatccagcgcaatcatccttttcatcatttatccttttacgcacaccacctgacgcagggtgtagataacttccaccagatcgctttgtgccgccatcaccgcatcaatatctttatacgccatcgggatttcgtcgatcacttcggcatctttacggcattccacatgcgcggtggcacgaatttgatcttccacgctgaacagttttttcgctttagtacggctcattacccgcccggcaccgtggctgcacgaacagaacgactcttcatttcccaacccacggacgataaagcttttcgctcccatcgaaccgggaataattccatattgaccagcacgcgcagacaccgcgcctttacgcgtcacgtagatctcttcaccaaagtgctgttctttttgcacatagttgtggtgacagttgatctcttccatcgccagcgtttgtggctgtctgaccgttttctgcgtaatgctctgcaatgccgttaccacgttttccatcatcgcatcgcggttaaggctggcaaaaagctgcgcccaggccacggctttcaggtaatcatcaaagtattccgtaccttccataaagtacgccagatcacgcgacggcaacgtctcaagcgtttcctgcatctctttttgtgccagatcgataaagtaagtcccgatggcgttaccaattccgcgtgaaccggagtgcagcataatccacacctgctccgactcatcaaggcagatttcaataaagtggttaccggttcccagcgttcccaggtgtttatagttattggtattcaggaaacggggatatttttgcgttaaccactgataaccggcttcaagctcagcccatttcgcatcgacgttaacaggcgggttttcccatgcgcctttatcacgtttacaacggccagtggtacgcccgtgcggcacggccgtttcaatcgcctgacgcagctctgccaggttttcaggcaggtctgccgccgttaacgcggtacgcagcgcgttcattccacagccaatatccacgcccaccgccgccggaataatcgcccctttggtcgggatcacgctaccaatggtggaacctttacccaggtgtacatcaggcattaccgcaatgtgtttgaaaataaacggcatcttcgccgtattaataagttgctgacgcgcatcggcttctaccggcacgcctttggtccacatttttaccggggcattttcagtggtcagtaattcgtaattcattttgtttttctcttttcgttgtttgctgtcgtgataattgcaaccgtcgtgccagaaaattaaataagcagattaattttttaattcattgtttttaaataggttaaatctttacgtccgtaaacggagattttccacaaaaccaattcaccgataatgaaatatcgtcttttataaggatatctaagatgcgtaaaacagtggcttttggctttgtcggtaccgtgctggattatgccgggcgcggcagtcagcgctggtcgaaatggcttccgacactctgtttatgccagcaagaatcgttggtcatcgatcgactggaattattgcatgacgcccgctcgctatttgaaacgcttaaacgcgatatcgccagcgtttcgccagaaacagaagtggtgagcgttgagattgaactgcataacccgtgggatttcgaagaggtttacgcttgcctgcatgatttcgcccgtggttacgagtttcagccagaaaaagaagactatttaattcacattaccaccggcacccacgtcgcgcagatttgctggtttctgctggcggaagcgcgttacctgcccgcccggctgatacaatcttcacctccgcgcaaaaaagaacagccgcgcggcgcaggtgaagtgacgattatcgatctcgatttaagccgttataacgccatcgccagccgctttgccgaggaacgccagcaaacgcttgattttcttaagtccggcattgccacgcgtaacccccacttcaaccgcatgattgagcagatcgaaaaagtggcgatcaaatcccgcgcgccgattctgcttaacggtccaaccggcgcgggcaagtcatttctggcgcgacgcatcttcgagttaaaacaggcgcggcatcagtttagcggcgcgtttgtggaagtgaactgcgccaccctgcgcggcgataccgccatgtcgacgctgtttggtcatgtaaaaggcgcgtttaccggggcgcgggaatctcgtgaaggtttattacgcagcgccaacggcggaatgttgtttcttgatgagattggcgaactgggcgcagacgaacaagcaatgctgctaaaagccattgaagagaaaaccttttacccgtttggcagcgatcgccaggtgagcagtgattttcagcttatcgccggaacggtgcgcgatttgcgccagctggttgccgaaggcaaattccgcgaagatctgtacgcgcggatcaatctctggaccttcaccctgccggggctacgccagcgccaggaagatattgaacctaacctggattatgaagtggagcgccacgcctcactcaccggcgacagcgtgcgttttaacaccgaagcgcggcgtgcctggctggcctttgcaacatctcctcaggcgacatggcgcggtaactttcgcgagctttctgccagcgtcacgcggatggcaacctttgccactagcggacgcatcactctggacgtggttgaagatgagataaaccgtctgcgctataactggcaggagagccgtccctccgcgcttacgcaactgctgggcgcagaggcagaaaacatcgatctcttcgaccgtatgcaactggaacacgttatcgctatctgccgccaggcaaagtcgctttctgctgccggacgacagctttttgatgtttcgcgccagggcaaagccagcgtcaatgacgcggatcggctacgcaaatacctggcgcgttttggtctgacctgggaagcattgcaggatcagcacagctccagttgaatatggtggtccgtcagcacctgcatcacgcttactggcggctgggcgtcggtgtagacggcatctaccatgctgatgctgcccatattgaccatcgcgttacggccaaatttcgagtgatcgacaaccagcataacgtggcgcgagttctcaataatggcgcgtttggtgcgaacttcgtggtaatcgaactccagcagcgagccgtcgctatcgatgccgcttatccccagaatgccgaaatcaaggcggaactgggagataaaatcgagcgtcgcttcgccaatgatcccgccatcgcggctgcgtaattcgccaccggcgagaatgatgcgaaaatcttcttttaccatcaacgtgttagcaacgttgagattgttggtgacaatgcgcaaattgctgtgattgagcagtgcgtgcgctaccgcttccggcgtggtgccgatatcgataaacagcgtcgagccattggggatttgctccgccactttgcgggcgatgcgctctttttcttcggtctgggtggccttgcgatcgtgccacggcgtgttaaccgaactggaaggcagcgccgcaccgccatgatggcgcaggatcaggttttgctccgccagctcattgaggtcgcggcgaatagtctgcgggctgacggagaaatgctctaccagctcttcggtactgacataaccctgctgtttaaccagttcgataataccgttgtgacgttgtgtttgtttcatttataaatccctggaattattttcgttttcgcgcattgagcgaatcaacaaaagccatcgctaaacccacggctaacccggcgatgtgtgctccgttcgccatcgacatcccaaacaaatcaaaccatccggcgacaatccagatcagcgcaaagataattaacccacgttgcaggtaaatgccactttgcggatcgcgttcgccacgtagccagacgtagcccatcagcgcatacaccacgccagaaagcccgccaaaccacggcccgctgaatttttgctgcacatagccgcttaacagggcgctgataagcgtaatgacaattagcttaccgctaccgaggcgtttttccaccgcaccgccgagataccaccaccagagcaggttaaagaggatatgcatcagcgagaagtgcattaacgcgtgggtgaagtaacgccagaactcaaatttcagtgttggatcgaatggccaggccagccataacatcacttcctgatcgccgagaatttgcatggcaataaacaccaccacgcaggcgatcatcatcacccaggttaccggacctgcgcgttcacgcaaggcggcaaagaaaggataacggcgataatgcaggccactgccggtatggcctgcctgccagctcgccgccagataacgcggatctgccgggttttcgagaaaacgcgccagctccgcccgtacgcgctcggcctgggactcatccgccagccagacatcgctttggttatgttgttgaatcgtgaggataacaccctgcgtcgccatgtaatcaacaaacgcctgcgccacgcgggggttagcaaaagaggtaatcatcaacatcgttgctgtcgcttattccacacaaaaggggacagtataaagcgttacgcgccgtacgccacctctgcgggaaactgacgttgccaggcttcaaagccgccgtcaatgctatagaccacatcgtagccctgttgcagcagatactgcgccgcgcctttgctgctattgccgtgataacacatcaccatcaccggagtgtcaaagtcgttatcacgcataaaagcgcccagcgtgtcgttggttaaatggaaagcctgcaccgcatgtcccattgcgaaactctgtggatcgcgaatatcgaccagcaccgcctctttttcctgcaacttctggtgcgcgtcggcaacgttaatacattcgaactgatccatgcgtctctctttctttacaaacaagtgggcaaatttaccgcacagtttacgtcgaagcggcagataaacgccataatgttatacatatcactctaaaatgttttttcaatgttacctaaagcgcgattctttgctaatatgttcgataacgaacatttatgagctttaacgaaagtgaatgagggcagcatggaaaccaaagatctgattgtgatagggggcggcatcaatggtgctggtatcgcggcagacgccgctggacgcggtttatccgtgctgatgctggaggcgcaggatctcgcttgcgcgacctcttccgccagttcaaaactcattcacggtggcctgcgctaccttgagcactatgaattccgcctggtcagcgaggcgctggctgaacgtgaagtgctgctgaaaatggccccgcatatcgccttcccgatgcgttttcgcctgccacatcgtccgcatctgcgcccggcgtggatgattcgcattggtctgtttatgtacgatcatctgggtaaacgcaccagcttgccgggatcaactggtttgcgttttggcgcaaattcagtgttaaaaccggaaattaagcgcggattcgaatattctgactgttgggtagacgacgcccgtctggtactcgccaacgcccagatggtggtgcgtaaaggcggcgaagtgcttactcggactcgcgccacctctgctcgccgcgaaaacggcctgtggattgtggaagcggaagatatcgataccggcaaaaaatatagctggcaagcgcgcggcttggttaacgccaccggcccgtgggtgaaacagttcttcgacgacgggatgcatctgccttcgccttatggcattcgcctgatcaaaggcagccatattgtggtgccgcgcgtgcatacccagaagcaagcctacattctgcaaaacgaagataaacgtattgtgttcgtgatcccgtggatggacgagttttccatcatcggcactaccgatgtcgagtacaaaggcgatccgaaagcggtgaagattgaagagagtgaaatcaattacctgctgaatgtgtataacacgcactttaaaaagcagttaagccgtgacgatatcgtctggacctactccggtgtgcgtccgctgtgtgatgatgagtccgactcgccgcaggctattacccgtgattacacccttgatattcatgatgaaaatggcaaagcaccgctgctgtcggtattcggcggtaagctgaccacctaccgaaaactggcggaacatgcgctggaaaaactaacgccgtattatcagggtattggcccggcatggacgaaagagagtgtgctaccgggtggcgccattgaaggcgaccgcgacgattatgccgctcgcctgcgccgccgctatccgttcctgactgaatcgctggcgcgtcattacgctcgcacttacggcagcaacagcgagctgctgctcggcaatgcgggaacggtaagcgatctcggggaagatttcggtcatgagttctacgaagcggagctgaaatacctggtggatcacgaatgggtccgccgcgccgacgacgccctgtggcgtcgcacaaaacaaggcatgtggctaaatgcggatcaacaatctcgtgtgagtcagtggctggtggagtatacgcagcagaagctgtcgctggcgtcgtgatttaatgtaaggtggccaggtcagatttcaatctgacctgagactgatgacaaaccaaaaaactgccagatgcgctacgcttatctggcctacgttgtttatacaatatattgaatttgcatgattttgtaggcctgataaggcgttcgcgccgcatcaggcatgaacaaagcgccacgttgtcaacaatctgacctactttttgattcagggaattaccgcaaagcccacgccatcatacccaacgtaacaaaacttaagcacgttccccactcactcaacttccgtatctggcatctatttttgctgcaccactggcaataatatcccaacgcaaaaccaagctgtgcgcttattggaccgataaaatccgtccacggctgaggccaaaatggcgaaaaattcaggggtagccagacaacaagcagaaagaaattgcggatactttccagcaacgcaattttcgctggcgcgatgtaaaaaatgatattccagaggatcaaccataaatagaccggtgcgaataccaaccaacaatggagcctgcttttcaattcagattgagttctacgagtaaattgccaaccaacgcaacacattacacagaagaaaagcgcatattcagccgataaccaaagttgtaattgcagaagtgaaatacgcctgatcatgagcgggattgagaacagcatttcccccagaaaactcagcgtgataatacaagcagccagcgcaaccaccatcggccacaccaacaacggcacaataacaaagccgagaaataacggataaatataaagtctgattatattcatcattattgtcctgatgattcgggggatgcttcatacagcggcacataccccacatcctctaccaactgttgcccctgctgacttataaaccagtcaacaaatttctgcgtttccggcgtgggattttcaagcgtcaccatataggcatccacaatgtatggataagtgccgttgcggatattttcctcggtaggcgcaacgccatttatagccaaaagtttaatctgcttgcgcattttgagcatattgtcattcatacgagtgacgtaatagtggaaggtgtacccaatggaagatggcgtgttttgatagtcggcaacttcagtaattaaaccgcccataagatcaatcacagtggattttttagctggcagcattggggtgtcttgcataaccaaccccttcataatcgtttggcttccagaatcttcagggcgctgccagacttttatatgttcgtcactaccacctactttattccagcggctagttttgccgctaaaaatatctttaacctggtgctcagagagagaatttaccgggttattaatatcaacgataaagacaaaggcttcgcgggcgaaagcggtatatttcagtttaacacccgcttcttctgcacgttttttctgtccttccgacggttgtgcaacaaaaataaccgtcgcggaacctttaatcagactatcgtaggcttcagctgttcgggtttgctgcaaaccatacgcctgccaggccagcgaggttcgatccttatcttttggctcgggtactaatttataatacgcggaggcatacagcgggtataaggctgtagcgccgtacactctcggccatcttgaccaatcatcgctgtaacgtaatgcaggttgcccccgcagagacgtcagtccatggctctcttcttccctaacgctgttatagtacccttcccggtcgacacatcccgccagtaacgccgtgcctaatagtaaaacaccggtgaatttattcatctcgctgattcctttctctcgagcgttattccattgttggatacagcggcacatatcccacatcttctaccagactctgcccctgcggcgttaaaaaccattcgaccagtttttgtgtttctgacgttgtattttctctcgtcaccataaatgcatcgacgatgtacgcatatttgccgttgcgaatgttttccgccgtcggtgtaataccgttaatcgctagcaattttatatttttatcagcattcatttgcgtcgcgtaatagcggaaggtatagcctattgcgttgtttgtattacggtattcggcaacgactttaatcattccctccatcacgcttgccactttcgtttcctgcggcgagatcatgcggacatttttcatgacctgtgattgcatcactgtctggctgccagagtcttccgggcgctgccaggtctggatctcctgatcgttaccgccaacagcacgccaattggtaattgcaccactgaaaatgtcacgcacctgttgttcagtcagggaattaaccggattatccgcattgacgatgaaaacgaatgcttcacgggcaaagggggtgtacagcaaagtgacaccagattcctttgcacgttttttttgcccaccggaaggttgcgccacgaaaataatatcagcatcgcccttaacgattttgttatatgcttctggcgtacgagagttttccagataatcccaaacgtgaaaatcctctggtattacacttaatgcataaaatgcagaagcataaattgggtacgcagccgtggcgccatcgattcgcggccagttttgcctaaactgaatttgcggtttgccacgcagcggcgtcagtcgattattgagtttatcgggtcgccaggcccagatatcaatattttcgcgtacaccgacaccaggattttgctgcttatataaatgggcctgatacccggcgacaataccaagtaagagaagtagaaacaggagtaagttacggcaacgtagtccggacgtgccggataaaggatatctggtcggccaggcgtatcccagcgaaaaactgatatgcgccccaacgggaataatgaccatccaccagtactcaccacccactaatgagactaaaaaaacgcccaaccagggttaatagcgcgggtaagagaaaaaagcattgccgccagacggctatttctctgttttctggcgcgctatcaccggcccacacgcgaccagagaaaaatattattatcgcccccagcgtcagcataaagacgttgagcagaaggtaaattgttggcgtgataaagatattacaaacttcaataataccggcaagtccgacacccagcatggcaataaccgccgccaaaaactgcgccagaatggggatgccgaaaaaagtcattaccagcgaggtcaaaatccattttctgttttgcattattctttccattctttctgaatggcgaaattatactccccgagtccccttgccccttctggacacttttccgaaatgatggcgaaaaaaacgggaccctttggccccgttctatttattagtgaaattacaatctcaccggatcaatatgccagatatgatcggcgtactctttgatagtacggtcagaagagaagtagcccatattggcaatgttcagcatcgcttttgcggtccactcttcctgaagctcgtagagttcatcgactttatcctgacaatcgacatagctgcgataatccgccagtacctggtagtgatcgccgaagttgatcagcgaatcaaccagatcgcgatagcgacccggatcttccggactgaatacaccgctgccgatttgcgtcagcacctgatgcagctcctcatctttctcgtagtattcacgcggtttgtagccctgacgacgcagttcttccacttcttccgctgtgttaccaaaaataaagatattgtcagcaccgacatgatccagcatctcgacattcgcaccgtccaacgtaccgatagtcagcgcaccgttaagcgcaaacttcatgttactggtgccggaagcttccgtccccgccagcgaaatctgttcagacagatcggccgccggaatgatcaactgcgccaggctaacgctgtagttcgggatgaacacgactttcagcttgtcgccaatctgcggatcgttgttgatcactttcgctacgtcattgatcaaatgaataatgtgcttcgccatgtaataggccgaagccgccttaccgccaaaaatattcacgcgcggtacccacttcgcatccgggtcggccttgatgcggttatagcgggtaatcacatgcaacacattcatcaattgacgtttgtattcgtgaatacgtttgatttgtacatcgaacaacgcctttggattcaccaccacattcagctgctgggcgatatactctgccagacgctttttgttctccagcttcgcctgatgcacagcgtgattaaccattgggaaatcacagtgttgttgcagctcattaagcaggctaaggtcggtgcgccagttacggcccaggtgttcgtccagcacggctgaaagcgatgggttcgctaccgctagccagcgacgcggcgtcacaccgttggtgacgttggtgaaacgacccgggaagattttcgcaaagtcggcaaacaacgattgcaccatcagattagagtgcagttccgatacaccgttaactttgtggctcacaacaaccgccagccaggccatacgcacacgacgaccgttggattcatcaatgatcgacgcccgtcccagcagatcggtatcgttcggatactgttcctgcaaggttttcaggaaatagtcgttgatttcaaagatgatctgcaggtgacgcggcagaattttacccagcatatcaaccggccaggtttccagcgcctcgctcatcagcgtgtggttagtgtaggagaagacctgacaacacacctcaaacgcgtcgtcccagctaaattggtgctcatcgatcagcagacgcatcatctcaggaatcgacagtaccggatgggtatcattgagatgaatcgcgattttatccgccaggttatcgtaggttttatgcaactgataatggcggcttaaaatgtcctgaatggtcgaggaaaccaggaagtattcctgacgcaggcgcagctcacgcccggagtaggtggagtcatccggatacagtacgcgagatacgttctcggagtggtttttatcttccactgccgcgaagtagtcaccctggttgaatttaccgaggttaatttcgctactggcttgcgcactccacaaacgcaacgtgttggtcgcgtcggtatcgtaaccagggattatctgatcgtaagcgactcccagaatctcttcggtttcaatccagcgcgtttttttaccttcctgctgaatgcgaccaccaaaacggactttatagcgcgtgttgtggcgtttgaattcccacgggttaccgtattccagccagtagtctggcgactctttctggctaccgttaacgatgttctgcttgaacataccgtagtcatagcggatgccgtaaccgcgccccggcaaccctaacgtcgccagagaatcaaggaagcaagccgccagacgtcccaggccaccgttaccgaggcccggatcattttcttcatcaatcagctcttcgagatttaaccccatcgcttccagtgcgccctgtacatcttcgtaaattcctagcgacaacatggcgttggagagcgtacggccaatcaaaaactccatcgacaggtagtaaacctgacgagtttcttgcgacaactgggcacggtttgaacgtaaccagcgctccacgagacgatcgcgcacagcaaataacgttgcgttcagccattcatgtttattggcgacgaccgggtcctttccaatcgtaaacatcagcttgtaagcgatagagtgcttaagagcttctacgctaagcgtgggcgatgaatatgtaaacggagcattcatataggcgtttcctgaaaactatttcaagcgatagtaaagctcacggtacgacttcgccgcgacctgccagctaaaatccattgccatagcctgacgttgcacaaaccgccacagtgaaggacgggaccacagtacaaaagcacgccgaatagcccgtaacagcgaccaggcattactatcttcaaagacaaacccactggcgacgccatctgcaaggttctcaagagaacagtcagaaaccgtatcagcaagcccaccggtgcgccgcactaacggcagcgtaccgtacttcaatccataaagttgcgttaagccgcacggttcaaaacggctgggcaccagaatgacgtccgcgccgcccataatgcgatgcgaaaatgcttcgtgatagccaatctgaacgcccacctgaccggggtattccgctgccgccgcaaggaaaccttcctgcagcaccggatcgcccgcgccgagtagcgccagctgcccgccctgctccagaaggcccggtaaggcttccagcaccaggtcgagacctttctggctggtcagacggctcaccactgcaaaaagcggcactttatcgtcaaccttaagccccattgcgatttgtaactggcgcttattttccgctttatcttccaacgtatcgcgggtgtaacgcgaggccaacagtaagtccgtctcaggactccagattttctcgtccacgccgttcagtacgccggaaagacgcccttcacggtgacgctgttgcaacagaccttccataccgtaggcaaactgcggttcggtgatctcgcgagcgtaggttggactgaccgccgtaatgtgatcggcatagtacagaccggccttcaggaaagagatttgtccgttgaattccagcccatgaatattaaagaatgaccatggcaattggatgtcattcatgtgatgtgcataaaacatgccttgataggccaagttgtgcacagtaaacaccgacttcgccggacgcccgcgcgccgccagatacgcaggcgcaaggcctgcatgccagtcgtgcgcatgcaccacatcaggacgccagaatgggtcaagcccgctggccatttctgccccaacccaccccagcagcgcaaaacgcaatacgttgtcggtataggcaaataagttggtatcgtgatacgggcttcccggacgatcatagagatgcggcgcgtcaatcaggtatatgccaaccccgttgtaatgaccgaacaacagcgtgatatgtccggcgaaggtatcacgacgggatactacttgcgcatcggtcacgccacggcgaatatcgggaaatgcaggcaacagtacgcgagcgtcaacgccgtctgcgatttgtgctgcgggtaatgccccaataacatcagccagaccgccggttttaagcagcgggaacatctctgaacatacatgtaaaacctgcattatcgctcctgtttatgccctaacttccgtagcatttcgcgcgttaccagcacgatgccttcttctgaacgatagaaacgacgtgcatcttcctctgcgttttcaccaatcaccatgccttccggaataacacaagcacgatcgatgacgcagcggcgcagacggcacgagcgacctacccatacttccggtaacaatacggcggaatcaatgttgcagaatgaattcacgcgaacgcgcgagaacagaacggactgcaccaccaccgaaccggagatcacacagccgccggataccagtgagttaagggtcatcccgtggctaccggagcgatcctgcacgaatttcgctggcggtaatgattcattgtaggtgcgaattggccaattgcgatcgtacatatccagttccggcaccacagaggccagatcgaggttcgctttccagtaagcttccagcgtacccacatcgcgccagtacggctcggcatccgggtcggattgtacgcaagagagcgggaacgggtgcgcataggccagaccggcttcggtgatcttgggaatcaaatctttgccaaagtcgtggctggagttctcatcacgatcgtcttcttccagcagttcatacagatagtcggcgtcaaagacgtagatacccatactcgccagagatttgctcggatcgttcggcattgacggtgggttagcaggtttttcaacgaattcgataattttatcgttctcatcaaccgccataacgccaaatgcggaggcttcttcaatcggtactggcatacaagcaacggtgcaacgtgcgcctttttcgacgtgatcgataagcatacgcgagtaatcttgcttgtagatatggtcgcccgccaggatcaccacgtattccgctttataacggcggataatatcgaggttttgggtgaccgcatctgcggtgccgcgataccagttttcccctttcattctctgctgcgctggcagcagatcgacaaactcgttcatttcttcattaaagaatgaccagccgcgctgaatgtgctgcaccagagtgtgggactggtactgggtgatcacgcccatacgacggatcccggagttgatgcagttagacagcgcaaagtcgataatgcggaacttaccgccgaagtgtacggccggttttgctcgcttattggttaaatccttcaggcgggtaccacgtcctcccgccagtatcagggcaacagatttcaatggcagctggcgcgccaacattaagtgatcgttcttctctaaactaaccatgactaactccttttttatcatctctggaacacacacaatccgtgtgcaggtccctgccagacagccgtaatcactgggttatcctctccagcgaatgggggaatggcgtgccactccccagcaggtaaaacaatctctgttacctcaagcgtggcgttaattgcgatcaaaaagcgatccgagagcagaatttgcagctgtttcggcccgttttgccactcatccgtgcttaaaggttgagcatatcgatttagccaacggacattgccgtcgccttcttcccaccagcgattctccaccaaagcgggaatacgcttgcgcagatggattaacgcggcggtaaatgcggttaaaccactgcttgcctgcgaccagtccaaccaggttaattggttatcctgacagtaggcattgttattgccatgctggctgtgaccatgttcgtcaccggccagtaacatcggcgtgccctgggagagcaacaacgttgttaacagggcatgaatgctgtcgcgccgccgttcaaccagatcaagagtaccacctaacccttctttaccatgattgttactgtaattgttgttggtcccgtcgcgattttcttctccgtttgcttcattgtgtttatggttgaagcaaacgcagtcgcgaagcgtaaaaccgtcatgtgcggtgacgagattaatcgcggcactcggcagacgaccattacgtttaaaaacatcgctggaggcagcaaaacgcccggcaaacgcccccagaggcaaatcataatgcagccagaaacgacgggcagcatcgcggaaatgatcgttccactcggcaaacagcggcgggaaatttcccacctgataaccaccaggagcgatatcccacggttcagcaattaacttcacctgcgagagcaccgggcagttctggatagcggtaaacaacggcgcatcctgacggaactctggcgtacggcccatgactgccgccagatcaaagcggaaaccatcgacgtggcaggtttctacccaataacgcaggcaggcgctggcataatccaccaccgccggatgactcaaattgagcgtgttgccgcaaccggtccagttgtgataatcgccgtcttctcttatccaataatagctacggttatcgatcccacgcagcgagaataacgggccgtcgaggtccagttccgcactatggttgagcacgatatcaagaatgacttcgatacccgctttatgcagtgctttgattgcatcgcgaaactcatccagcgccgtttctggcgagcaggcatacgccggatgcagcgcaaacatcgccaccgggttgtaaccccagtagttacttagccccatgcgttgcagacgtggttcactggcaaactgcgccactggcagcagttccagcgcggtaatgcccaattgtttcaaatagttgatcatcaccggatgcccgagggctttataagtgccacggatctcgaccgggatctccgggtgcaagtacgttaatcctttgacatgggcttcataaatgatggtgctgccccacggcgtgcgcggcggggcatcatcttcccagtcatagtgatcaaccaccactacgcatttcggcgcaatggcggcgttgtcgcgatagtcaggttcattatgaccggcgtgcagcagcgggttatctttaaactccccgtcaatttgccgcgcgcaaggatcaatcaacaacttcgccgggttaaagcgatgcccctcggcgggttgccaggggccatgaacgcgataaccataacgcaaacccgggcgcgcatccggcagataaccgtgccaaatgtcgccactgtgccctggcaagtcatagcgatgttcctggccattggcgtcaaagacacacagttctacccgctcggcatgaacggagaaaagtgtgaagttgacgccctgaccgtcgtaatgcgcgccgaggggagcgggtttgccaatggcgagttgtgtcattctgcctcccgaaccagccagatagtggccagcggtggtagcgtcaggcttagtgaatgctgacgaccgtggctggcaatctcatcgctgtgtaccgtgccgccattgcctgcattactgccgtgatagtgcatggaatcggtattgaggatttcacgccatttgcccggctgattaatgccgaagcgataatcatgacgcggtaccggcgtaaagttactggcaacgatgatttcgttaccctctttatcgcgacgcacaaagatcagcaccgagcgttctttgtcatccaccaccagccattcaaagccgtacgggtcaaaatccagttcatgcattgctttatggtggcggtaggtgaggttcagatcgcgcaccagacgctggacaccgtggtgccagttatcgccgccttccaacagatgccagtcgaggctggcgtcatggttccactcgcggccctgggcaaattcgttacccatgaacagtagtttcttgcccgggaatgcccacatccagccatagtaggcgcgcaggttcgcgaatttctgccatgcgtcgcccggcatgcggtcgagaatcgattttttaccgtggaccacttcatcatgcgacaacggcaggacgaagttttcagtgtagttgtagagaatcccgaaggtcagtttatcgtgatgatactgacgataaaccgggtcgagcttcatgtagtccagggtgtcatgcatccagccgaggttccacttgtaccagaagcccagaccgcccatatcctgcggacgagaaacgccagggaaatcggtagactcctcagccattgtcaccgcaccggaaacctgctcaccaagaatacggttggtattacgcaagaattcaatcgcttcaagattctcgcgcccgccaaattcgttcgggatccactccccctctttacggctgtagtcgcgataaatcattgacgccaccgcatcgacgcgcagcgcatcaataccaaaacgttcaatccagtaaagcgcgttaccgacgaggaagttactgacttcacggcgaccatagttgtagatcagcgtgttccagtcctgatgatagccttcacgcggatcgctgtgttcatacaagttcgtgccatcaaattcggcaagcgcaaagtcatcggtcgggaagtggcctggcacccagtcgagaatcacgttcagaccagctgcgtgtgcggcatcaatgaaataacggaagtcgtcgcgagtaccaaaacggcgggttggtgcatacaggccggttggctgataaccccaactgccatcgaagggatgctcgttaatgggcagtagttcgaggtgggtaaagcccatccatttagcataaggcaccagttgatcggccagctcgcggtagctcaaccagaaattgttgtcggtgtggcgacgccaggaacccaggtgaacttcataaatagagattggcgcatcaaactgattcgcttttttgcgctcttcagtctgtacaaccttttccggcagcccgcaaataagagacgcggtttccgggcgcatttgcgcttcgaaggcataagggtcggacttcagacgcaagttgccattggcatcaatcatctcgtatttatagagctgaccgttatgcgccccagggataaacagttcccagatgccgctctctttacgcaggcgcatcgggtgacggcgaccgtcccagtagttgaattgcccaaccaccgagacccgacgggcgtttggagcccagacagagaaacgcgtacctgtgacgccatccatagtatctgcatgcgcgcctaaggtttcatacgggcgcaggtgagtaccttcagataatagccaggcatccatttcctggattagcggaccaaaacggtaaggatcatcaatcaggttttgctgaccatgccagacaacagccaactgatagcggaaaaaattcttacgtcgcggaatgacgccgctaaagaatccccgtgagtcgagacactccagttttgcgagtttgcgcccggttttcggttcaatcacccacacatcggtagcgtcgggtaaaagggcacggacttccagtcccgcggtggttttatgcattcccagtacggaaaaaggatccgcaaaatggcctgcaattagcgcgttaatcacgtctctatcgatacgatcggacatgcttgtcttcctgttttattgtgtcaccccatccaattggatttttgacttctggttgtgacatttttttgacctgaacggcgcagcactctgtgcatcctctctgcgtcgtcctcacttcaggtaaggctgtgaatactcatgtattcagccacccttaaagaatagccaatgctctatttaactcccggtaaatcatgaaacatctgcgcttactcctgtattacgcactaacaggggcggcatcgcgccccagatttaatgaataaagattacgccagttgacgaagcatccgacgcagcggctccgcggccccccacagcagctggtcgcccactgtaaaggctgacaggaactctggtcccatattcagcttacgcaggcggcctaccggcgtggtcagcgtgccggtaacggcagctggggttagctcacgcatagtgatttcccgatcgttcggaacgactttcgcccacggattgtgcgcagccagcagttcttccacggtcggaatagacacatcttttttcaatttaatagtgaatgcctggctgtggcagcgcaatgccccgacacgcacacataaaccatctaccggaattacggaagatgtgttgaggatcttgttggtttccgcctgccctttccactcttcgcggctctgaccgttatcgagctgtttgtcgatccacggaatcaggctacccgccagcggcacgccaaagttatccaccggcagctcaccgctacgggttaaggttgtgactttgcgttcgatatcgagaatagcagaggacggggtcgcgagttcatctgccacatggccatacagatggcccatctgggttaataactcacgcatatgtcgcgcaccaccgccggaagcggcctggtaggttgcaacggacacccaatcaacaagatcattggcgaataaaccacccaacgacatcaacatcaggcttacggtacagttaccgccaacaaaagtcctgatgccattatttaatccgtcggtaatgacgtcctgattgacggggtcaagaatgatgatggcgtcatctttcatgcgcagagacgatgctgcgtcaatccagtaaccttgccatccgctttcacgaagctttggatagatttcgttggtataatcgccgccctgacaggtcacaatgatatcgagggcctttagcgcctccagatcaaaggcatcctgaagtgtgccagtggttccgccaaaagacggcgcagcctggccaagctgagaagtagaaaagaagacagggcgaatggcgtcgaagtcgcgctcttcaaccatgcgttgcatgagaacggagccgaccataccgcgccagccgataaaaccaacatttttcataagcgttttttcctgcaaagatgtgtgctgtataaatgtgccggtctcctcttggcacatctttcaccatacaaaaagcagccaaagtcgcaagtgaaattaatcaatgatagcgaagccatcagtaatgcgacttatcctgctttgttagcacgcagaaagtccgcggcaattatcagggaatttgagttatgaatgaaatcatttctgcagcagttttattgatcctgattatggatccgctcggaaacctacctattttcatgtccgtactgaaacatactgaaccgaaaagacggcgggcaatcatggtgcgagagttgcttattgctctcctggtgatgctggtgttcctgtttgcgggtgagaaaattctggcatttctcagcctgcgagcagaaaccgtctccatttctggcggcatcattctgtttctgatcgccattaagatgattttccccagcgcttcaggaaatagcagcgggcttcctgcaggtgaagagccatttatcgtgccgttggcaattccgttagtcgccgggccgactattctcgccacgctgatgttgttgtctcatcagtacccgaatcagatggggcatctggtgattgctctgctgctggcctggggcggcacctttgtcatcctgctacagtcttcgctatttttacgtctgctgggcgagaaaggggtgaacgcacttgaacgcctgatgggattgattctggtgatgatggcaacccagatgttcctcgacggcattcgaatgtggatgaaggggtaacgaggagagtttttcgaaaagaacccggtagcgtcacaactaccgggcgaacaaacttaactcaacagctggaacgcaatcatcccaacgatggcaccgacagtgccgagaatggtttccatcatggtccaggttttcagcgtttcggcttcggtcgcgccggtaaatttaccgaacaaccagaaaccagcgtcgttaacgtggctgacaacaatcgaaccaccagcgatacaaatcgacagtgccgccatttgcgcaccagagtagttcagttgttcaatgactggcatcaccagtcccaccgccgttaaacaggctacggtggcagacccctgaatgatgcgcactgcagcggccagcacgaagcaggtgatagcaatcggcaggcccatgccggttaacgcttcgcccagtgccggacctacgccagagtcaaccagcacctgtttgaacacgccgcccgcaccaatcaccagcagaatgatccccgccggttgcagcgcgtgaccgcaaatctccatcactttgtcttttggcatgccctgacgcatcgccaggccataaatcgccaccagacaagcaaccagaatcgcggtaaacggatgaccaataaactcgaaccattcgtaagcggtagagccttctggcacaaaacgcgcggcaatggttttcagccccaccagcaccagcggcaacaggatcagcgacaggctgaatccgaaggacggcattttgccttcgccgagatgcggttcgctgatgtcgtcaggaatatgcaactccacgtaacggctgatgaaattaccccacagcggcccggcaataatcattcccggaattgccgcacacaggccaatcaggatcatccagccaaaatcggcgttcatctgcgatgccagcagcattggcgctggccctggcaccaggaacgccgccgctgccgccacgcctgcgaataatgggattaccagcttcaccaggttcgtaccggtgtggcgcgccattgagaaagcaacgctaatcagcagaacaatcgccacttcaaagaacagcggtagcgcacagaccagccccgcaaggccgatggcataatgcgcgcggctgtgaccgaaggatttgagcattttgacggcaatctgatcgactgcgccggtttcatgtaagatcttgccaaacatagctcccagggcgacaaccaccgccaggaagccgagggtgcctcccatccctttttccatcgtcgctgcgattttatcgagcggcataccggaaaaaaggccagcccccatggacaccaccattaaagccaggaaagcgtgcatacgcgccttcatgactaaaaacagcagcagtaaaacagaccctactgctgttaaaacaagcgttaatgtagtcactacttatttgccttttttaataacctcaatggtgcttgccacaacaccttccagcggttgatcgatatccaccaccagtacatcggtttcgtccgcacccggctcctgcagcgtttcaaactgcgtcaccaacatttgggttttaaagaaatggcctttgcgcgctttcaggcggctttcaatcacatcaaaatcgcctttcaaatagatgaaagagagattcggattaccttcacgcagcaagtcgcgatagtgttttttcaatgcagaacagacgatcagcgacactttattagtgcgctgcatagcaaacgcggcgtcgttcagcgcctgcaaccacggtttgcgatcgtcgtcattcagtggttcgccagacgccattttttcgatattgcgccgtggatggaggaaatcgccatcaagaaacgcggcatgaagttgatgcgccacttcactggcgaccgcagatttgccgctgcccgatacgcccatcaagacgtaaatgtggtgatcatggttagtcgtgctcaaagtggtgcccccacaatacaagaattaaaaatgttacgggtaactgttatcggtaacattgtccagccggacaatatcagaagcaatatccatccatgccttaagtgtataagtgtgagctacttcaaatttgtgggcttaaatagatccgcccggtgacaaggtgaaacctaaatctaacattttcggtgtcacagattcgccacgaatacgcgccagcaggcgttcagcgccaatactgcccatccgctcacgcggcgtcagcacgctcgcaagtcgtggctccatcacctgaccaatgtcatgaccgtggaaaccggcaatcgccatatcgtcaggaacttttaaccccagacgctgacattcaaacgccgcgccgaccgccaggtcatcattcgtacagaacacgccatccagctgcggatattcccgccgcgcctggcgaatcagttcaataccggaagagtaagaagaagattgctcaaccatcacgctatatggcaccaggcctgcatccagcatcgcctgttcgtatcccttctgtttgatgatagtacgttcgtcgagacgtgcgccgagataggcaatgtggcgatgcccgcgagcaataatggcagtggtcatctggcgtgctgcttcaaagttatcaaaaccgacggcgatatcaaggcatggcgacttgctgtccatcagttccaccacgggaatacccgccacttcaatcatctttaaggtgcgcggcgtgtgggtacgttcggtgaggatcaggccgtcgatattccaggagagcatggattcgaggcgttcttgctccatttccggtttataaccgtagtgcgccagcatggtctgataaccgtgcgcgtcggtgacgctttcgattccgcgtaatacttccgcgaaaacctggttggtgagagaaggtaacaggacgccaatcgcccggctggtggcgttagagaggatatcgggcgcacgattgggaatatagcccagttcatcaagagccgcggcaatcttgccgcgtagagcgacggaaacctgctccgggttgcgtaaaaaacggctgaccgtcattttggtcacgcctacacggtcagccacatcctgaagtacgggtcttttctttttcatcgtcctgaaggtacaaaagagatagattctcttagtttaacacggacacatcagaaccttcccggggaaaacagtgcttgtttacaattattagatatacactaaatcaattgcatcgcattgtgctaacgacgcggcaaaaccccggaagcgtacatcagcacgcgaccggagcgagcgaggaagcctgcaaaaaggcaggcttcaaagatgccgttgagttttaaaccggcggcagatcgaacagtaacacttcgctgtcgctatccgcatggatggagattgcctgctcatcccagattgccagaccatcgctggtcgaggctttcacgccgttaatggtgacattgcctttcaccacctggatccagacgcggcgttcagcggcaatctgatgcaccgactgctcatctttcagcaacgcccagcggtacagttccatatcctgatgcactttcaatgaaccatctcgcgcatccggcgagagcaccagctgtttgccctgtacggcatcgaagcgacgctgttcataacgcggcgtaataccgttttcttcaggcatgatccagatctgatacagatgcagacgctcggtgctgcttgggttgtactctgagtgacgaatacccgtaccagcactcataatctggaactcacccgccggaacctgctctttattgcccatgctgtcctggtgctcaacagtaccttccagcacgtaggtcaaaatttccatatctttatgtgggtgagtgccgaagccctgccctgcttcaatcacgtcgtcgttaatcacgcgcagcgcggagaagcccataaagttcggatcgtaatagttggcaaaagagaaagtatgccaggagtccagccagccatgatttgcatgaccacgttcatttgctttgcgtaagtagatcatttgtattcgccccctgaatgatttcgatgggcttagtgtggacccgatctgcctgggatgatagagggtgaaaattgacccctctgttcaaaaaaattgaactattcgaggggccatcaaacttacttcgcgagagtcactgtggagggagaggcttgctcgaatccgcgttcaaggatttccagattcgtaagaacttcagattccttgacgtaatttggcgcaccgtgggtgatggtttgatacaacgcatcataaacgcgcccgtaatcgcccatctccggcttaatctcttctctgaccgtcacgccctcgtcattgacatactccagcacaccgaccgaatcatccgctgagaatcccggttcgcccggcataatattagccttcaggctggtttcctgctggtcgataccatatttaataaacgaacctttcttaccgtgaacgataaatttcggataatcgattttcaccagatggctggttttgacgatggcttttagatcgccataaaacagttgcgcttcgaaagtatcgtcaggattggctttattgcgcaggctgcggatgtcataagcgacgtgatccgggcgaccgaacagagaaataatctggtccatcgtatgcacaccaaggccatagaacgcgccatcctgcggcaacccaggtttggtttctgcgaccgggcggtaatagtcaaaatggctttccacttcaacaatctctcccaacttgccactttcaatcgcttttttcgctgtcaggaagcaggagtcaaagcgacgattctgatacggcgtgacggtcagccctttgcttttcgccaacgcaaacagctccttcgcctgggcaagcgtcggggtgaacggtttttcgaccagcacatttttcccggcttccagcgcgcgtttcgcgtactcgaaatggctgtccgcgtgggtgcagacaacaaccagcttaacatcgggatcgtttagtacttcgtcgagatcgctggtgaaatggatatgggaataaatgggagcctgttcttccggcttcgcatggcgacgaaaaatatgcgcgacatgccaactatccttgcggttaagtacatacggcagatggtaacgggtggtgcttttgccgaagccaataaaggcgcagttgatgaccatgatttcgtcctttttaaggtggttatttacaccttagcgcaaagcggacgtggttcctactggagtgcgcataacgaacacaagcactcccgtggataaattgagaacgaaagataaaaaaaaagccagcacccggctggctaagtaatactggaagcaatgtgagcaatgtcgtgctttcaggttctccgcgagggtcttcctgatcgcgagacaataataatcattctcattcgcacttgtccaacactttttgcaaaaaaatgcatttgactcgcattcgaaagtcaatgatgttgaaagggacatttaccccaaagaggacaaaggaatgagtgagatagtgatacgccatgctgaaacgcgcgattacgaggccatcaggcagattcacgcccagccggaggtgtattacaacacgctacaagtgcctcatccttccgattatatgtggcaggagcgactcgccgatcgtcccggcatcaagcaactcgtcgcctgtattgatggagacgtcgtgggccatctcaccattgacgtgcaacagcgcccacgccgcagtcatgttgccgattttggtatctgtgtcgactcccattggaagaatcgcggcgtcgccagcgcccttatgcgagagatgattgaaatgtgcgacaactggttgcgggtagatcgcattgaactaaccgtgtttgtcgataacgccccggcaattaaggtctataaaaaatacggctttgaaattgaagggactggtaagaagtacgcattgcgtaatggtgaatatgtcgatgcgtattatatggcgcgggtgaagtaagatagtgccctttttctgagatgggaaaagggtgtcattcaaaatcggcataccttcctttaatgtatttattttcccaataaatatattgagatttacctcataattacttcctaaagtgtaatattttattttttaatatatacgcctacaatttcctggagtaaataaataacaattaacaagcataatagtgccattgataaaatagcatgccataaaaggacttttcagggatgagtaatattgtttacctgacagtaacgggagaacaacaaggaagcatctccgcaggttgtgggacttctgagtctacaggtaatcgttggcagagcgggcatgaggatgaaacatttacattctcactcttaaataatattaataatacggggcttggttcacagttccatggtataacattttgtaaattaattgataaaagcactccattatttattaattccattaacaataatgaacaattatttatgggatttgacttctatcgaataaatagatttggtagatgggaaaagtattattatatacaactaagaggcgcttttttatcggctattcatcaccagatcattgaaaaccaactggatacagaaaaaataactattagttatgaatttatcctctgtcaacatcttatcgcaaataccgagttcagctatttggcactccctgaaaattataaccgtttgtttttaccaaattcaaaaaaccaaacaaataatcgtttcaaaacgttaaacagcaaagctattggcaggctacttgctgctggtggcgtatacaatgggaacattgaaggattcagagatactgcggaaaaactgggtggagatgcaataaaaggctatgatcaaatactaaatgaaaaaacagcgggcatagcgatagcaacagcatctattcttttaacaaagcgttataatgttgatacatatacagaaataaatagttacttaggcaaacttagaggtcaacaaaaacttcttgatggtatagacataatagaaataatatacattaagagaccttcaaaagacttagctaacttacgaaaggagtttaataaaactgtaagaaaaaattttcttatcaaacttgcaaaaacctccgaagcatctggaagattcaacgccgaagaccttttaagaatgagaaagggcaatgttcctctaaattataatgttcaccataaactatctctagatgatggtggtactaatgatttcgaaaatttagtattaatcgaaaacgaaccatatcataaagtttttactaacatacaatcacgaatagctaagggaatattagtaggtgaaagcaaaatcactccctgggccattccatctggctcaatttatcctcccatgaaaaatattatggaccacacaaaatgatgactaaaacccaaataaataaattaataaaaatgatgaatgatttagactatccatttgaagcaccgctcaaggaatcatttattgaaagtataatccaaatagaatttaattctaattcaactaattgcctggagaagttatgtaatgaagttagtattctttttaagaatcaacctgattatcttacttttttaagagcaatggatggattcgaagttaatggattacgattatttagcctctcgattccagaaccttcagttaaaaacctttttgccgtaaatgaattttatagaaataatgatgatttcataaaccctgatctacaagaacggttagtgatcggggatgatagcatttcaatatttacttatgacattaaaagtaacttttttgaaattagagataatattggcacagaaaatatattcagttcgtttagtgatttctcttcattcttaaacgaaatcatggacagttgttcataataatcaaaaggaaacaaaaatcattgtaaaccatgccatctttttagagattaccagcagaaaattccttgttcgaaatttagcagtgcaagctatggaaaaacttacaacggaactacactccttaagtgagatggaccgaagacatgtagtctctattttagccgaaatagctaatggctatgatgattttaatgacatgttgatttatttagaattttacccgaatcataagattctgatatcttaaataagaaaatcccgttcgacgttctgaaaaagaaatcataaaatattagcagatacttatttcgtgactatatcttatccgatgaacttttttcaaaaccagcatttaataatatctttgacgaagatgaacgcgtctttgctcaatgtatcacacaggaataataatataacactcaacaataatatttattataattatgattacttatcacgacgcattcgcgaaagcgaaccattaccttgatgatgcagatctcccggtcgtcattactctacatggacgctttagccagggctggtatttctgtttcgaagcacgagaatttctcgaaactggagatgaggccgcgcgcttagctggtaacgcaccttttattattgataaagacagtggtgaaattcattctctgggaacggcaaagccgctggaagaatatctacaggattacgaaataaaaaaggctaccttcggcttgccctgacaaaatagccctcttcccacgaagagggccgctaaccttagtaccccgccgttaaatcatccaccgagcgcgggtcggatgcgccgtacaactcaccgtccggcccaaccataatgctttgtgtactgcccatcgcctctttcagcgccactttctgaccttttgcttccagcagcttgagcgtatccgggctaaaccctttttcgacacgcagctcgtccggcaaccactgatggtggaaacgcggcgcattggtcgcttcggcgacgttcatgccataatcgatgctattcaccaccatttgcagcactgtagtgatgatccggctaccgcctgggctaccggtaaccagccaggttttaccgtctttcaccacaatggtcggcgacatcgacgacagcgggcgtttgttcggcccgacggcgttggcatcaccgcccaccagcccgtaaacgttcggtacgcccggtttggcggagaaatcatccatctggttattaagcagaataccgctctcgcccgcgacaatacccgtaccgaaggtggtgttcagcgtataggtcaccgccaccgcgttaccgtctttatccactacagagtaatgggtagtttgattactctcataaggcgcaagcttgccagggcgaatctcactggacggcttcgctttgttgatatcaatttgatcggcaatggatttggcataggctttattggtcagtgcctgccacgggactttgacaaaatccgggtcgccaagatattccgagcggtcggcgtaggcgtatttctccgcttctgccatgatttgcatcgcatcggcgctgccaaagccgtatttcttcatatcgaagttttccagaatattgaggatttgtacgatatggatcccgccggaggatggcggtggcatggagtaaacctgatacccgcgataatcgccgcttatcggagtgcgttcgaccgctttataggccgctaaatcttctttagtgatcaagccaccgtttttctgcatctcctgggcgatctgttccgcaatcgtgcctttatagaattcgtccgggccgttttcagcaatcatctccaggctctttgccaggttcgcctgcaccagcgtgtcgccctttttcagcggctcgccctctttccagaagatagctttactgttttcgtgattcggcaacacttcgctaccgtaggttttgagatcgtcagccagcgcgtcgttaacgataaaaccatcgcgtgccagtttaaacgcgggctgcacgactttgttcagcggcatggtgccgtatttatccagcgccagcgagaaacctgctaccgtacccggtgtgccggaagccagatgcgaagtgagtgattttttgctgtccgggttgccctgatcatcgaggaacatatcgcgggtcgctttggcgggtgccatttcgcggaaatcgatagccgtggtattgccatttttcgagcggattaacataaaaccaccaccgcccagattccctgcctgcggatgcgttaccgccagcgcgtagcccaccgccacggcggcatcaacggcattcccgccctccttgagaatatccacccccacctgagtggcagtggcgtccacagacgctaccattccctgtttcgcgcgtaccgggtggaagacatcttcctccacaccatacgagacgggcggcgcaggaggcgcggcggcggcgctaaaacaacttcctgagagcagagcagcaatggccacccggcgtaaaaacgtcggttttatcatcgttattctccagagattaaggggcaaccccagctaagcctggtatataactctgaattaatcatcgttttgtcgggaagcgagtaaacttaaaggatatcttcagaggaggatacgcgatgaaacgacttctgattcttacggcactcctgccgtttgtcggctttgcacagcccattaatactctgaacaaccctaaccagccggggtatcagatacccagccagcagcggatgcaaacccagatgcaaacgcagcaaatccagcaaaaagggatgctgaatcagcaactgaaaacgcaaactcagttgcaacagcagcatttagaaaaccagataaacaataattctcagcgggtgttgcagtcacagccgggggagcgaaatcccgcccggcagcaaatgctgcccaacaccaacggcgggatgttaaacagcaaccgtaatccggatagttcgttgaatcagcagcatatgctgccggagaggagaaacggcgacatgctgaatcagcccagcacgccgcagcctgacattccgttgaaaactattgggccgtaaagttcggaccaatcacgtcaatcgcatcggtacagatgcaatccacgccccagcgcagcaactctgccgcgcgctggggtttattgacggtataaaccagaatccgcagtccggcgtctttcaactgcatcactcgcactttatcgagtaacttatgattgagatgaatagagacgcagcccagccgcgcggtcagttcgcgccagtcgtcgcgccactcatccagcaacaaaccgcgcggcagttccggtactgcctgttgtgcggcttctaaagcatcaatctcaaacgatgacagcagcggcggcgtcataccggcccacagttggcgtgccgccagcgccaccattttgcccgttaatggtccagtgccaatggtgggtttgatttcgatattcgccatcatcccgtgttcacgacagcgttccgccacctgcgaaagcaacggcagcggctcacctttaaacgctttgctgtaccaactgcccgcatccacgcgcagtaaatcctgccagttcagttcacccgcgacgccccagccgttgctggtgcgttcgagattgtcgtcatggagcaggaagatctcgccatctttcgataacttcgcgtcaaattcgatcatcttatgaccgtattttgccccgacgtcgattgccgccagggtgttttccggggccagcttaccgccgccacgatgagcgacgatgcggggataaggccagttactcatactcgttgtcctgtttcaccatcaaaaagatgcagctgattttccgccagatgcagccacagcgtgctgcctgccgtcgggcgctcctgatgcgccagtcgcaccaccagcttctgctcgccccagcgtccgtgcgccaggttatctgcgccgaggatctccagcgtgtccatcaccagcggtacgccgccttctgcctgcgagcttagcgcaatatgttccgggcgaatgccgagagtcattttacgcccggcatactgacggtagccaccgtttagcggcagctcaataccgccgtccagttcgaaatgcgtgccttcgttattcacgcggcctgtcagcagattcatcgccggactgccgataaaactcgctacaaacaggctggcgggcttttcgtagacttcaactggtgtgccaatctgttcggcaacgccgccgttcatcaccattactcgctgggcgagcgtcatcgcttcaacctgatcgtgagtaacgtagagtgaagtcgttttcaggcgacggtgcaactgttgcagttcaagacgcatctgcacgcgcagcttggcatcgaggttagagagcggctcatcaaacaggaacaccgccggatcgcgcacaatcgcgcggcccatcgccacacgctggcgctgaccgccggaaagctcgcgcgggcgacgtttgagcagaccgtccagctccagaatgcgcgccgcttctttaacgcgctcggcaatttgctgcttgcccatgccgcgaattttcagcccccacgccatgttttcttcgacactcatatgcggataaagcgcgtagttctggaacaccatcgcaatcccgcgatcttttggctccatttcagtcacgcgctggtcgttgatccagatatcgccttctgtcacccgctccagcccggcaaccatgcgcagcagcgtcgatttcccgcagccagacggcccgaccatcacgataaattcgccatccgccacatcaagggtcagcggtttaatgacctgggttttaccatcccagcttttggttactgcctgtaatttcagtcctgccatcttatttctcactatcgaccaggccgcgcacgaaggcacgctgcatcactaaaacaatcaccaccggagggataagcgttaacaacatcgccgccatcactgagttccattccgtggtgccttcgcctgtagcgatcatccctttgatccctgccacggtggtgccgagatccacatcggtaataatcaacaacggccacaaatactggttccagccgtaaataaaggtgatcacaaacagcgccgccagattggttttggagagcggaaaaacgatgtcgcaaaagaaacgcattggtgacgcgccgtcgatccgcgccgcttccaccagttcatccggcagcgtcataaagaactggcgaaacagaaacgtggcggtcgccgaggccatcagcggcagcgttaaaccggcgtagctgtcgagcatcttcaggttggcgatgacttccaccgtcgggaagatacgtacttcaaccggcagcatcagggtgataaaaatcatccagaagaagaggttacgtagcggaaaacgaaaccagacaatggcaaatgccgagagcatcgagacggtaattttgccgagcgtaatgctgaacgccatcacaaagctgttaagcaacatccgccagaacggcgcgctattcgtgcctaccccgttcacccagatgttgtggatgttttccagcagatgtgtgccggggatgagcgtcatcggcgcggcatagacggcctgtttatccagcgtcgccgcgacaaacgccacgtacagcgggaagaggatcaccgcgatcccgaggatcagcatggtatggctgaatatcgtcagccacggacggttctcaatcattggtaacgcaccttgctttcaacatagcggaactgcaccaccgtcagcacgatgacgaggaacatcaacaccaccgactgtgcggcagacgaagccagatccagtccggtaaaaccttcgcggtagatcttataaatcagcgtcgtggtggcctgaaccggcccgccggacgtggcggcgtcgatcaccgggaaggtgtcgaagaaggcatacaccaggttcaccaccagcaggaagaaactcaccggagcgataagcggcagcgcaatcttaaagaagcggcgaattgggcctgcaccgtcgatggctgcggcttcgatcaacgaacggggaatggattgcagcgcggcatagaagaacaggaagttgtagctgatttgcttccatactgaggcaaacaccaccagaaacattgcctgaccgctgttttgcgcgtggttccagtcgtagccgaactccgcgagaaaatgggtgatcagcccgcgaccggggttaaacaggaagatccacaatacggcggcaacggcgggagccacggcgtaaggcagcaacattaaggtttgatagaaacggctgccgcgcacgatgtactccaccagcgccgcaaagaacagcgataccagcaaaccgctgacggtgacaaaggtgctgaattttatcgtcgtccagaaggagtcgagatagtagctgtcatggaacagcgtgacgaagttatccaggccgacaaactggctggagaaaccaaacggatcgacgctttgtagcgagtaccacaacgcttcgcccgcaggccagataaaaaagataacggtgatgatgagctgcggcgcgaccagcagataaggcagccagcgcgagcggaacaccggacgggatgatgacattacggttaattcctgaactgtgccggatgcgcttcgcttatccggcctacacgcgatgccaggtcagataagcgaaacgcatccgacattacactgattaagacttcgtcgatttctcaaagcggcgcagcaactgatttccacgctcaacggcggtatccagtgcctgctgtggtgtcttcttaccggtccacacgctctccagctcttcatccacaatcacgcggatctgcggcatgttgcccagacgcagccctttggtgaacggcaacggcggcttattcagcatctgacgcgtcgcggtatccgcccctgggtttttctcataaaagccctgctcacgggtcaggtcatacgctgctttggtgattggcagataaccggttttctgatgccactcggcagcgttttctggcttcgcgaggaaatcgaggaacttcgccacaccggtatacgtttctttatctttaccctgcatcacccacaggctggctccgccgataatggcgttttgtggcgcatctttcgcatcggcgtcgtaaggcatcatgcctacgccgtagttaaatttggcgtactcgcgaatgttggcaagagaaccggaagaggcggtggtcatcgcgcaatcaccgttatagaacttctcggtggattcatccttacgaccgacgtagctgaagtcgcccttcttgttcatctcctcgagcatggcgatgtgtttcacctgctccggcttgttgaactccagcaccgcgtccgtgccgtcaaagccgttgtttttgctggcaaacggcagaccgttccaggcgctaaagttttccagttggatccagccctgccagccgctggcgtagccgcacttcataccggaggctttcagtttcgcggcatagtccgccagatcctgccaggttttcggcggttgttccgggtctaatcctgctttcttgaaggcgtctttgttgtaatagagaacgggggtcgagctgttgaatggctgggagagtaagtggcccgttttgctgtcggagtagtaaccggaaaccgtcggcacaaactgcgactcatcgaattgaatccccgcctctttaaacacgtcatataccggtttaatggctttcgatgccatcatggtggcggtgccaacttcataaacctgcaaaatagccggagcgttgccggtacgaaatgcggcaatccccgcgcttaaattctgttcgtagttgcctttataggtcggtacaattttgtaatccggattttcggcgttaaaacgttgggccagagaatccacctctttacccagttccccttccatagaatgccagaacggaatggtcgtcactgcctgtgcattccccattaacgccagtccgagcgccagtgctgaagctgtataatgtaacggtttcatcgtttatctctcttgttgtaccgaatgcgcgaattcacgcgttttatgctcgcggggtaacatgacatgctcgaattacagaaaaataacttttttgttacatttgtaagatagtaaggtgtcagaaagatgacaaggcggtgacggcgtgggtgagggaaaatgggagatggggcacggataagcggaaaaatagaaggtctgaatcaaactctacagattactcatcgtttcatgccagatgcggcgtaaacgccttatccggcctacaagatcgtgcaaattcaatatattgcaactcacccagtaggcctgataagcgcagcgcatcaggcaattttacatttgtcacctgtctcaaaggagtcttttgactccttatcaatcaacgtgttattacccgcctaaatacgcacttctcactgcttcgttcgccagcagcacgtcgccggtatcggagagcaccacatggccgttttccagcacgtagccgcgatccgccagctttagcgcctggttggcgttctgctcgacgaggaagatagtcatcccctgctcgcgcagctgctcgatggtgtcgaaaatttgctggatgataatcggcgcaagaccgagcgatggctcatcaagtagcagcaaacgcggattgctcatcagcgcgcgaccaatcgccagcatctgctgttcaccgccggacatggtgcccgcccgctgaacacggcgctcatgcagacgtggaaacagttcatacacccactttatgcgctcctgaaactggtcacgttcggcaaagaagccgcccatcgccaggttctcttccaccgtcatccgcgagaagacgcgacgcccttccgggacaatcgctaccgcttcgcgcatgattttcgccgtctgccagtcggtaatgtctttatcatcacacacaattcgcccgctggtggcgcgcggatcgccgcataacgtaccaagcaaggtggttttccccgccccgttcgcgccaatcagcgtgacaatctcgccctgattgatatgcaagctcacctcatgcagcgcctggattttgccgtagtgggcgctgactttgtcaaaggacaacatgactttttccatcttatgcctcacctaaataggcacggatcacgtccgggttattacggatttgctccggcgtaccgtttgccagtggcgtcccctgattgaccacgtaaattcggtctgaaatccccatcaccagcttcatatcgtgttcaatcaacaagatagtggtgttgtgatgattgcgcagttcggcaatcagctcatccagctctttcgtctctttcgggttaagacctgccgccggttcgtcgagcattaaaatctccggctgcgtcaccatgcaacgggcaatctccagacggcgttggtcaccataggccaggttactcgcctgacggttggcgtgttccagcaaaccaatgcgctcaagccaggtggcggcgcggtcgagcgcttcgctctgggcgcgacggaaagaaggcgttttcaacaggccagagaacagcccggttttcagttgctgatgctgcgccaccagcaggttttcaattaccgtcatttcacggaacagacgcacatgctggaaggtgcgcaccacgcccatgcgggcaatttgctgccccggtaaaccttcaagatgctgatcgcgcagtaaaatggtgccgccggtgggtttgtagaaaccggtcaggcagttaaaaaccgtggtttttccggcaccgttagggccgattaacgagacgatttcctgcgggtacagttcaagattgacgttgttcaccgccagcaggccgccgaagcgcatcatcagaccgttaacagataataatggctgactcatgcctgctctcctttcgctgcgccgtttttcagcttcagttgcgggcgcgtcatgggcagcaagccctgcggacgccagatcatcatcagcaccatcaaaccaccgagcattaacatgctgtattcgttgaaatcacgcatcaattcgcgcgacaccaccagcaaaattgccgccagaatcaccgcaaattgcgagcccataccgccgagcaccactatcgccagcacaaacgccgattcggcaaaggtgaaggattccgggctgacaaagccctgacgcgccgcaaacagcgttccggcaaaaccggcaaacgcggcgctgatggtaaaggcggtcagcttgatacgacgcgggcttaagcccagcgaacggcaggcaatttcatcttcacgcaatgcttcccacgcacgccccagcggcatccgcagcaggcggttaatgacaaacaggcttagcaccaccagcagcaacgccaccagatacaggaagatgacgcgatcggagggatcgtatttcaggccaaagaaattactgaacgtgtcccagccgccttcacgagcggtacggctgaactcaaggccgaagaaagtcggtttcgggatctgactgattccgttcgggccgccggtaatttcggtgttattgagcagcaatatgcgcacaatttcgccgaagccaagggtaacgatcgccagataatcaccacgcagacgcagcaccggaaagccgagcaggaagcccgccgccgctgccattaacccggcaatcggcagacaagtccagaagcccaagccgtaatagtgattgagcagcgcaaaggtgtaagcgccgatggcgtaaaaaccgccgtaccccagcaccagcagaccagaaagaccaacaaccacattcagcccgagaccgaggataatgtagatcatggtcagagtggcgatatccaccgtcccacgtgacaccataaacggccacgccaccgcaagcaccagcagcgccacgaggaacagtttctgcttcaccgtggagccatcaatggcgggcagaataaacttcggtccggaaacacttttcaaccctttctggaaagcaggtcgcaaaagctgaaagaaaaagaccaccgccgtgccgataaacacccactgccaacggacatccgaagcgctgtcgaccaccagtttggtgccatccagctccagttgcacgcccataaagacgccagcgaggacaaagaacatcgcggcagagagcagcgccattgcaatatgcatcggtttcatactttctctacctccgggcgacccagaataccggtcggcatcaccagcagcaccagaatcagcagggcaaatgaaaccacatccttatattccgtactcagataggcagaagagagcgcctccgcaatccccaagatcagcccgccaatcatcgcccctggaatgctgccaatcccaccgagcaccgcagcggtaaaggctttcatcccggccataaagccgatataggggttaatgacgccatagaactgaccgagcagtacgccagccactgccgccatcgccgcgccaataacaaaggtcaaagcaatcacccggtcggtgttgatgccaagcaggctcgccattttcagatcttccgcgcaggcacgacaggcgcgccccatacgggaatagcgaatgaaaatcgtcagcgccagcatggcgaggaaggtgacaatccagatcaccgcctgcatggtggtaatagaggcagagaagttttcgctatggcccaccacccactgaccgttaaacaggctgggcagcgccacatcgcgcgaaccttcggtcaggctgacgtagttttgcaggaagatggacataccgattgcggaaataagcgcaatcaggcgcttagaattacgcaccgggcggtaagccacccgttcgatactccagccgtaggcgctggcaatgacgattgcgccgacgaatcccgccgccaccagcagccagccggtatcaatgcccatcatcatcagcgcggcgatgatcataaatgagacgtagctgccaatcatataaacctcgccgtgggcgaagttgatcatgccgataatgccgtaaaccatggtgtagccgatggctatcagcgcgtaggtactgcccagcgtgacgccgttaaacatctgctgcaagaaatacaaaaactgctcagacataaggtaacctttctaaacccgcccgcattttacgggcggtgggatgatcacttggctgccgtggatgaaccgtcggcgtgccactggaagacaccaaaatcaaatcccttaagatcgcctttttcatcccagttcagcggcccaatcacggtgtttgcaccgttagcttttaaatctttcaccagcgccagcggctcatcgctgccagtacgctcaagggcagtcgccagagattgcaccgccgcgtaggtgatccagacataaggcccggacggatctttcttgtctgctttcagcgcatcaacgatgccctggtttgccggatcctggtcatagcgttttggcatagtgaccaacatgccttcggcagcatcaccggcaatattcgacaatgatgcgttacccacaccttccggccccataaactgagttttcaggccaacggaacgggcctggcgcagcatctgccccatttccgggtagtaaccgccgtagtaaacgaagtcgatgttttcttttttcaggcgggcgatcagcgcggagaaatctttctccccggcggtaataccgtcgaagaagacgacgttggcgttagccgctttcagcccgtcctgcaccgaacgcgccagcccttcgccatactgttgtttgtcgtgaatgatggcgatgcgctggggcttcaccgtctcaagaatgtattttgccgccgttggcccctgggaagagtccagcccggcagtacgcataatgtgttgataaccgcgttgggtcagctccgggttggtcgctcccggcgagatcatcagaataccttcgtcttcgtagatatctgatgcaggttgggtagaagaagaacacagatgaccaataacgtatttaatgccgtcattaacgattttgttggcgaccgcaacggcttgtttcgggtcgcaggcgtcgtcatattccacgccaaccagcttgtcgcccttaattccccctttggcattaatgtctttaatcgcctgacgcgcgccgttaaattccatatcgccccactgggcaatcgggccggacatcgcgccgacaacggcgactttaatatcgtcagccatagcggtgtgtgaaattgccagtgcaatcatccctgcgatgatagttttcgcattccgtttcatagtcaaaaatccccattcgtgatgttgtgttgctttgtttttatgtgttaacaaatcagactgttctttttttatactgcactgtttttgcctgtctgattaagggtttagcgcagtattttgtgatactagcgattaaaatccctatttttcagtcgattaagaacagataatattctgaatttattgatagataaacagaaaaaagtgcctttgtcagcataaaataacggcacaaagggcggaataattcactaccattcaggggattatgctgggtatttttcattctctaatgttttaactttgtaattattgctgttaaaaaattaatcacctgccaaaagaaataaaaaagagaaagcctccgattaaattatttcgctacactggttccacttttgtgatttacacgggttacccatgaagctgaccatcattcgattagaaaactttagcgaccaggaccggattgacctgcaaaagatctggccggagtattccccttcctctttacaggttgacgataaccaccgtatctacgccgcgcgttttaacgagcgcctgctcgctgccgtacgggtaaccttaagcggcaccgagggagcactggattccctgcgtgtgcgggaagtcacccgacgtcgcggtgtggggcaatatctgctggaagaggttttgcgtaacaatcctggcgtttcatgctggtggatggcggatgcaggcgtggaagatcgcggtgtgatgacggcgtttatgcaggcactgggatttacggcgcaacagggcggctgggagaagcgttaatcgtcaagttgatttcaaaagtgatgaccaacgagaaattgcctgatgcgctacgcttatcaggcctacaatgtgtgttgcaatttactgatttctttggatcttgtaggccggataaggcgtttacgccgcatccggcatgaagcaacgtactcgatattagcaatttggcggcaacccaaagttgccgattaatgattacttcgcatcggtcgccgtgccgttggcgtgccagtcaaatacgccgaactcaaagcctttcagatcgcctttctcatcccacgtcagcggtcccattacggtatccacggagttcgctttcaggtatttggcgatttcagccggatcgtcagactgattcaggcccgcctgcaaagattgcagcgcggcgtaggtggtccagacgaatgcgccgcttgggtcctgttttttcgctttgatcgcgtcaacaatgggtttgttcgccggaacctgatcgtagttcttcggcttggtcaccagcagcccttccgctgattcgcccgcaatgttagacagcgaaacgttagccacaccttccggccccataaactgagttttcagccctgccgcgcgtgcctgacgcaggatttgccccatttccgggtgataaccgccgtagtaaacgaagtcgatattctcttttttcagacgcgccaccagcgttgagaaatctttttccccggcggtgataccatcaaagaacaccacgttagcattgcctttcttcaggccgtcctgcaccgctcgcgccagaccttcgccgtattgctgtttgtcgtgaacgatagcaatacgctgcggtttcactttctcaagaatatatttcgccgccgtcggcccctggtcggagtccaggccggtggtgcgcaggatcagctgatagctacgggcggtcagctccggcgcggttgccgctggggtgatcattaaaatgccttcgtcttcgtagatatcagacgcaggctgcgttgatgaagaacagaggtgaccaatcacgtatttaatgccgtcgttaacgactttgttcgccaccgcaaccgcctgtttcgggtcacaggcatcgtcatattttacgatttgcagtttgttgcctttaatgccgcctttagcgttgatatccgcaaccgcctgctctgcgccggtaaactcctggtcaccgtactgggccaccggaccggacattgcgcccacgaccgcgactttaatatcttctgccagagccatattgctgaatgccagcgcgatacatcctgccagtaacgctttaccctttatgttcatcctgagaatccccattcttctggttattacgtgtgttgtgatgttgttgttcagcactttatttcgttttatgcatgactacccgtgctttagcagcatactctgctaaaacatacccgatttttatgatattggaatagctattttgacagtttattaacaatctgcgtggggattggcgttttgccggaggggaaattgattattgtagaggctcaaaaaacaaaaaccccggactcgcatccagggttctctgcttaatagcggaaattacgcttctatagcagcgcgcagttttttcatcgcgttcttttccagctggcgtacacgttcagcggaaacgccgtaacggtcagccagttcctgcaacgtggacttgttgtcttcgtccagccagcgcgcgcggatgatgtcctggctgcgttcgtccagaccctgcatcgcgtcggtcagacggtttgccgcctgctcttcccagttatcatcttcgatgccgtcggcaaagttagatgatttatcctgcagatagagcaccggtgccatcggttggctgtcggaatcgtcgtcggaagacaggtcaaaggtcatgtcctgtgccgccatacgtgattccatctcacgtacgtctttgctggttacgcccagttcacgggccaccatttcgacttcatcctggttaaaccagcccagacgctgcttggttttacgcaggttgaagaacagtttgcgctgcgctttggtggtcgcaactttgacgatacgccagttacgcaggacgtattcgtggatctctgctttgatccagtgaacggcgaaggagaccaggcgcacacccacttccgggttaaaacggcgcactgctttcatcaggccgatgttaccttcctgaatcaaatccgcctgtggcaggccatagcccgcataattacgagcaatatgaacaacaaaccgcaggtgagacaggatcagcgttttagctgcttccagatcgccatggtaatgcagcttttcagccagcgcccgctcctcgtcagccgacaacatcggccacgcgttagctgcccggatgtaggaatccaggttgccaactggggctaaagctaaactttgcattttgtcagtcattcaaatcctctcaatcgatatcttctggcgcttcagtggtagcaacaactgtgccagagcttaagagcaacgaggttatcattcactgttttatcagaccgtgattttatccacaagttcaatgcaagcttgtgaataaattacgcacaaaatgtgacatagagatgaaataccgggaagagacaacggggtctctttccctgctacggaacccattgcagggaaagagtataacacgcttttattattcaggcgtaaagtggcgtaaatgttgtaccgtggcaagccacgctgccacccagccaatcatcgagcataccagcagcaacagcaggcattcatcgaacgataaaccattgatatcaaacttcgttccgaaaacctgtgccacttccgcaaccgccgatgacaatcgcagtaccagaatttctgacaaaattagtgacaacaatgcgccagaaaatcccagcagtgcgccaccgtacaggaacgggcgcaggatgaaaccatccgtcgcaccaatcagtttctgcacgttaatggagtcacggcgagcaaagatgctcagacgtacgctgttgccgatgacgaggaacacggccgccaccatcaatacgccgatcatcgccgaaacgcgcccgaccagcccagtcaacgccgccagacgggcaaaccagctgtcatccatccgcacttcgtcaatgccgttaatctgcgtgatacgatcacgcagcgtattgagtgattccgtcccctgaaaatcgagtttcgggatcaccaccgccactgccggaagcgggttttcttccagcatatccagcgcgccgccaaagccagaccagttacggaactcgcccagcgcgtcttcacgagaaagataattcactttctccacgccttgctcggcctgcaactgtgccaccacgcccgcagcagcgtcatcgtccagcgttttttgcagataaacagtgatttgcggtgacggataatactgcgtcgccgcctggttaacgtttttgtacaccatataacagacgctgggcagcgtcagggagatggcgataaccatcaccgttaaaaatgtggcgaacggtttgcttttcagatcctgcaatgcgccgtggaaggcatagcgcacctgttcgttgaaaacgttggttttgcgatttaccggttttggcgaggatttcgcgcgtttcggtgcgttacgaccgccatcgcctgagccgccgaccgatttacggaagcgatccagacgcccgccaaactgccgaatatgattgattgcatcgcgcttattcatggcccacgcctccatgcaagtgaccatcgctcagggtgagcatgcgataggaacgccgtgaaatcaggttgaggtcgtgcgttgccatcaatacggttaccccaacgcggttaaactcttcaaacagacgtagaatcccttccgacaacgcgtcgtccaggttaccagtcggttcgtccgccagcagtaccgcgggcttattcaccaccgcgcgggcaatgccaacacgctgttgttcaccgcccgaaagctgaatagggaagttcttcgctttgtccagtagcccgactttatccagtgccgccgacacccggcgacgaatatcgtcaccgctggcaccagcgataatcagcgggatcgccacgttatcgtagacagtacggtccatcagtagatggtgatcctggaaaatcatgccaatctggcggcgcagaaacggaacttcacggtttttcagacgcgtgatgtcatggccgctaaaccagattttcccggcgctgggccgctcaatcccacagatcagcttcaggagggtacttttccctgcgccggaatgaccggtcagaaacgccatctcacccggctgcatatggaacgtaacgccctgcagcgcctgtctcccaccgagataagccttgctgacatgttcaaagcgaatcattgttaatcctctcgggcaaaaagtgcctctataaagtcgtccgccttaaacggacgcaaatcctcaatacgttcgccgacaccaatgtagcggatagggataccaaactggtcagccaccgagaaaattaccccgcctttcgccgtgccgtccagtttcgttagcgtgatgccggttaaaccaacggcttcatggaacagtttggcctggcttaccgcgttctgcccggtgctggcatcgatagtcagcataacttcatgcggcgcttcaacgtcgagtttcttcatcacgcggacgattttcttcaactcttccatcaggtgcgatttgttctgcaggcgtccggcggtatcggcaatcaggacgtcgatattacgcgctttagctgcctgaatggcgtcgaagataacagaggcggaatccgcaccggtatgctgggcaatcaccggaatattgttgcgctgaccccagacctgaagctgttcaaccgctgctgcacggaaagtatcgcccgccgccagcatcaccgatttaccctgctgctcaaactgacgtgccagcttaccaatcgtcgtggttttacccacaccgttgacgcccaccatcaggatcacgaacggcgttttaccttcaacattcagcggctcatcgactttcgccagaatctcgcccatctcttctttcagcaggccatagagcgcctcggcatcacgaagctgcttgcgggatgcgccttccgtcagattggtgataattttacgtgtggtttccacgcccacatcggcgatcaaaagctgttcttccagctcttcaaacagatcatcgtcgatttttttaccgcggaacaggctgataaatccggaaccgagattttctttggtttttaacaggctgcgtttcaggcgcgcgaagaaaccttctttggtcggtttttcctgctcctgagcgatttcttccaccggctgctcttcttctgccggaggaaccaccatcaccgcctcttctgccgcttcggcagccagcgcctgtgcttccagctcttcgtcggtgatttcttctttagccgcttcttcttccgccgcttcgacaatctctacggtttccgcttcagcctgccactcttctggcgaaacctcttcggcgttgacgtcttccggcaacggcagctcttcacgttcgatagccactggctccggcgtttcttctacgaccggttccggctgtgcaacgactcccgcttcaggctgcgctttttcactttcagcaacctgttcagtgacttccacaacgtcggcagcaaaagtttccgcctcggcttcagtatgcgcctgcggctgctcttcaacggcttgttcagaagccttcgcaggctcttgcacctgaacgatttcttctacaaccgattgttcattctgaacttctgtctctttttccggggtctgctctttttgaccaaagcccagccaggaaaaaaagccacgttttttttctttcgccatttgcgactacactcctcgctgttgcttcatggcacagcgttaacgctatgtacatagcagctaaaaaaatgatgaaatagtctatcacttaacttaattcacatcaccgcctgcaagtatgtgttatctggcggattgagcaatttatcatgaaaaaaccgaatcattccggcagcggccaaatccgcattattggcgggcagtggcgaggccgtaaactaccggttcctgatagcccaggtctgcgccccaccaccgaccgcgtacgcgaaacgttatttaactggctggctccggtcattgttgacgcccaatgtctggattgcttcgccggaagcggcgcgctggggctggaagcgttatcacgctacgctgcggaggccacgttgattgagatggatcgtgcagtttctcagcagttaattaagaatctggcgacactaaaagcaggcaatgcacgcgtagtgaacagcaacgcgatgtcattcctggcgcaaaaaggcacaccgtataatatagtgtttgtcgatccaccgttccgccgtggcttgttagaagagacgataaatttactggaagataacggctggctggctgacgaagccctgatttatgtcgaaagcgaagtcgaaaacggtctgcccactgttccggcaaactggtcattgcatcgggaaaaagtggcgggtcaggtggcttatcggctgtatcaacgcgaagcacaaggagaaagtgatgctgattaatattggacgtttgttaatgctctgcgtttggggatttttaatcctcaacctggtgcatcccttcccgcgcccgctgaatattttcgttaacgtggcgctgatttttaccgtgctgatgcatggtatgcagctggcgctattgaaatccactttaccgaaagatggcccgcagatgaccaccgccgaaaaggtgcggattttccttttcggcgtgtttgaactgctggtctggcagaagaaatttaaagttaaaaaataaccttattgttcgccaacaaagctaacaaagcgcgttcctttatagctcagcgtacctttatcgcccactgtcagggcgtggtactgctgggcgtcgaggcgaaacgtttgctccattcctccgctttgcggtttgaagcttgcctcatagcgcatactggtgcctgccggagtcacttcctgctggcgcgaacggcgatcgttaatcggtttttcccgcttgttgctcaccaccaccagcttttgctggagcggagccatatcattatcagctttttcccgtcgctgttgcataaaacgaaacgatgcggcgacgacaattaagccaatgataacaataaagaaaagaggtggtttgctcatctttatccctcatcggaaaatgcggaaataagcataccctgccagttatggtgttgtcatccgtccaccctcgccactaaactggaagcaagaccgtaggcattccgcttacgaaaaaataacgaattcaaggaactaagatgctttggtcgtttatcgctgtctgtctttccgcatggctatctgtggatgcatcgtatcgtgggccaacctggcaacgctgggtgtttaaaccgttaacccttcttctcctgttgttactggcctggcaagcgccgatgttcgacgccattagctatctggtgctggcggggctgtgcgcctcactgctgggcgatgcgctaaccctgttgccacgtcaacgtctgatgtacgccatcggcgcgtttttcctctcgcacctgctgtacaccatctatttcgccagtcagatgacgctctctttcttctggcctctgccgttggtactgctggttctgggcgcgctgttactggcgattatctggacgcggctggaagagtatcgttggcctatctgcacgtttatcggcatgacgctggtgatggtgtggctggtaggtgaactgtggttcttccgtccgaccgctccggcgctctctgcgtttgtcggcgcttcgttgctgtttatcagtaactttgtctggctgggtagccactatcgccgacgcttccgtgcggataacgcgattgctgcggcctgctactttgccggtcacttcctcatcgtccgctcgctgtatctctgataaaacttgactctggagtcgactccagagtgtatccttcggttaatgagaaaaaacttaaccggaggatgccatgtcgactcctgacaatcacggcaagaaagcccctcaatttgccgcgttcaaaccgctaaccacggtacagaacgccaacgactgttgctgcgacggcgcatgttccagcacgccaacgctctctgaaaacgtctccggcacccgctatagctggaaagtcagcggcatggactgcgccgcctgtgcgcgcaaggtagaaaatgccgtgcgccagcttgcaggcgtgaatcaggtgcaggtactgttcgccaccgaaaaactggtggttgatgccgacaatgacatccgtgcacaagttgaatctgcggtgcaaaaagcgggctattccctgcgtgatgagcaggccgccgacgagccacaagcatcgcgcctgaaagagaatctgccgctgattacgctaatcgtgatgatggcaatcagctggggtctggagcagttcaatcatccgttcgggcaactggcgtttatcgcgaccacgctggttgggctgtacccgattgctcgtcaggcattacggctgatcaaatcaggcagttacttcgccattgaaacgttaatgagcgtagctgctattggtgcgctgtttattggcgcaacggctgaagctgcgatggtgttgctgctgtttttgattggtgaacgactggaaggctgggccgccagccgcgcgcgtcagggcgttagcgcgttaatggcgctgaaaccagaaaccgccacgcgcctgcgtaacggtgagcgggaagaggtggcgattaacagcctgcgccctggcgatgtgattgaagttgcggcgggcgggcgtttgcctgccgacagtaaactgctctcgccctttgccagttttgatgaaagcgccctgaccggcgaatccattccggtggagcgcgcaacgggcgataaagttcctgcaggagccaccagcgtagaccgtctggtaacgctggaagtgctgtcagaaccgggtgccagcgccattgaccggattctgaaactgatcgaagaagccgaagagcgccgcgcccccattgagcggtttatcgaccgtttcagccgtatttatacgccagcaattatggccgtcgccctgctggtaacgctggtgccgccgctgctgtttgccgccagctggcaagagtggatttataaagggctgacgctgctgctgattggctgcccgtgtgcgttagttatctccacgcccgcggcgattacctccgggctggcagcagcggcacgtcgtggggcgttaattaaaggcggtgcggcgctggagcagctaggtcgtgttacccaggtggcgtttgataaaaccggtacgctgaccgtcggtaaaccgcgcgttaccgcgattcatccggcaacgggtattagtgaatctgaactgctgacactggcggcggcggtcgagcaaggcgcgacgcatccactggcgcaggcgatcgtgcgcgaagcacaggttgctgcactcgccattcccgccgccgaatcacagcgggcgctggtcgggtctggcattgaagcgcaggttaacggtgagcgcgtattgatttgcgctgccgggaaacatcccgctgatgcatttgctggtttaattaacgaactggaaagcgccgggcaaacggtagtgctggtagtacgtaacgatgacgtgcttggtgtcattgcgttacaggataccctgcgcgccgatgctgcaactgccatcagtgaactgaacgcgctgggcgtcaaaggggtgatcctcaccggcgataatccacgcgcagcggcggcaattgccggggagctggggctggagtttaaagcgggcctgttgccggaagataaagtcaaagcggtgaccgagctgaatcaacatgcgccgctggcgatggtcggtgacggtattaacgacgcgccagcgatgaaagctgccgccattgggattgcaatgggcagtggcacagacgtggcgctggaaaccgctgatgcagcattaacccataaccacctgcgcggcctggtgcaaatgattgaactggcacgcgccactcacgccaatatccgccagaacatcaccattgcgctgggactgaaagggatcttcctcgtcaccacgcttttagggatgaccggactatggctggcggtgctggcagatacgggtgcgacggtgctggtgacagcgaatgcgttaagattgttgcgcaggagataaggcaaaccgatcgcaacattgagcgcgatcggtcccctcgcccctctggggagagggttagggtgaggggaaaaggcggcatcgaagccaatcagcccccatcaaccgcctttacgaatcaaataacgataaggcagtccatccgtctctttcgcaaccagttcgtgttccataaaggtacaaaacccaggaatatcgcgggtagtggccggatcgtcggcgataatcagcaacgtttcgccgggctgcatattgcgcacagttttgcgcaccatcattacgggttccgggcagcgcaggccaagtgcgtcgagtgtgtggtcagggctggaaaagagatcggtcattttcttctcatcacataaaaaaacggcgctagtttacgccctgtgagtccgtaagcaaaccaggttaacgattgcgtgaaaattaaccattgcattgtcaacgtaaagcagtatcatgcggcggctcgaaaaaagggtaagcacgttattatgttaaggtaacagacgtgtcgtacgtattgggttccctcaccccaatggttaatcaaaaaggtacaatatgaacgttttctcgcaaactcaacgctataaggcgttgttctggttatcgttatttcatctgctggtgatcacctccagtaactatctggttcagcttcccgtctccattttgggtttccataccacctggggcgcgtttagctttccgtttatttttcttgctaccgacctgaccgtgcgtatttttggcgcaccgctggcccgacgcattatcttcgcggtaatgatccctgcgttattaatctcctacgtcatctcgtcgctattctatatgggttcctggcagggattcggcgcactcgcccacttcaacctgtttgtcgcccgtatcgccaccgccagtttcatggcctacgcgctggggcaaatcctcgacgtgcacgtttttaaccgcctgcgtcagagtcgccgctggtggctggcaccgacagcgtccacactgttcggtaacgtcagcgacacgctggcctttttcttcattgccttctggcgtagcccggatgcctttatggctgaacactggatggaaatcgcgctggtcgattactgtttcaaagtgttaatcagtatcgttttcttcctgccaatgtatggcgtattactcaatatgctgttgaaaagactggcagataaatccgaaatcaacgctttgcaggcgagttaaaggttcgttatcagagttgtgataagatggatgaatgagccgttatggccgtttatcgaaaggaagaagtcaatgcgcaatctggttaaatatgtcggaattggcctgctggttatggggcttgcggcctgtgatgataaagacactaacgctacggcgcagggttcggtcgcggaaagtaacgctaccgggaatcccgtcaacctgcttgatggcaagttaagtttctcgctgccagcggatatgaccgaccagagcggtaagctgggaacgcaggccaataacatgcatgtctggtccgacgccaccgggcagaaagcagtcatcgtcatcatgggcgatgatccgaaagaagatctggcggtgctggcgaagcgtctggaagatcagcaacgtagccgcgatccgcagctgcaagtggtaaccaataaagccattgagctgaaaggtcacaaaatgcagcagttagacagtattatctccgcgaaaggccagacggcgtactcttccgttattctgggtaacgtgggtaatcaactgctgaccatgcaaattacgctgcccgctgacgatcagcaaaaagcgcagaccaccgcagaaaacatcattaatacgctggttattcagtaagttttaagatgatgaggcggcctcagggacgtgttccggaggccgtttttttaatcgccacgtcagtaataacgcgattgcgaccagtcccgccgccgccagataaatcaccggtacgcccgcccagctcatcaccagcccagccagtggtccagtcacgccaagcgataaatccataaatacggtgtaagttgccagcgccgccccctgattttgctgcggaaccgcttttaccgccactacacccaatgccgggaacaccagcgaaaacccggcccccgccagtaagacgccgattttcgccatccacggcatagtcgccacgccaaccagtagcaggccgattatctcaacgctaaagcaaatcatcgctacgtttaagccaccgatacggttaatgccgttagggaataacaaacgcgtaccgacaaacgcacagctaaacagcgtcagcgcgaaagccgcaccgtcccaacctttagcgtcataaaacagcgtgataaaggtggcgatgacgccaaatccggcggaagccagtgccagcgccataccgtacagccagacgcgcccaagcaccgcgcgaaacggcagcggtttgcctttactggcttttaccgtcggacgcgggatcgccaacaaaatggccaccagcgccacgcccataatgattaacgctaacgcctgcaagccgccccagtgataaaacacgacgcctaacggcgcacccatcgccatcgccccgtaagtgacaatgccgttccacgaaatcacccgcccgatatgcagcgagccaaccacgccaacgccccatagggtcgatcccgttccggcaaaactttgcccaatcccaaggatgacgcgccccaggcaaagtaataacaggctgatgacaggcagactggcggttaatcctgccgtcagataccccagaccgctcaaaaagcagccgcataaaccgaggacgacaatctttttgggtcccagcgaatcggcgtaacgtccggcatgagggcggctcagcaaggtggcgaaatattgcaggctgataaccaatcctgcccagaaggcgctaaagcccatcacatcatggacatagcccggtaatacagcgagcggcaacccgatggtgaggtagctggcgaagttaaacatgactatagagacaatgcgcaaattcaggcgcaatccgtttagcgcgggttcggctacgggttcgggcatgaggatcaccacatttttacaacagtgtttcatttttaccacgtgctgacgtgaaaatcagcagtaagaatcagaatattgctggcgtgactcccgctacacttaatacaaaaagtcacaaggaagccccaatggaaacccctcaacccgataaaacgggcatgcacattctgctcaagctggcctcgctggtagtgatcctcgcgggcattcacgcagcggcagatatcattgtgcagctgttactggcgctgttttttgccatcgtcctcaacccgctcgtcacctggtttattcgtcgaggagtacaacgccccgttgccattacgattgtagtggtggtgatgctgatcgcactaaccgcgctggtcggcgtactggcggcatcgtttaacgaatttatctctatgctgccgaagtttaataaggagctgacgcgcaaactttttaaattgcaggagatgttgccttttcttaatttgcatatgtcgccggagcgaatgctgcagcggatggactcggaaaaagtggttaccttcaccacagcgctaatgaccgggctttccggggcaatggcgagcgtgcttttgctggtgatgaccgtagtttttatgctgtttgaagtgcgccacgtcccttacaaaatgcgttttgcgctgaataatccacagattcacatcgcgggattacaccgcgcacttaaaggcgtttcgcactatcttgcattgaagacgctactcagtttatggacaggtgtcatcgtctggctggggctggagctgatgggggtgcagtttgcgctgatgtgggcagtactggcgtttttgctcaactacgtgcccaatatcggcgcggtaatttccgccgtaccgccaatgattcaggtgctgctgtttaatggtgtttacgaatgtattctggtcggcgcattgtttttagtggtccatatggtcatcggcaatattttagaaccacggatgatgggccatcgcctggggatgtccaccatggtggtatttctttcattgttaatttggggatggctgctcggcccggtagggatgctactttcggtgccattaaccagcgtgtgtaaaatctggatggaaaccaccaaaggcggtagcaaactggcgattttactggggccgggcagaccgaaaagtcggttaccgggatgaggcgacaagtgatacgatacgcactttcattttccattaaacgttggccctgatatgtatcggatagttctggggaaagtttcgaccttaagcgcagctccactgccaccgggtttacgcgagcaagcaccgcaaggtccacgacgcgaacgctggctggcggggcgtgcattgctttcgcacacgctttccccgctaccggagatcatctatggcgaacaaggcaaacctgcatttgcgccggaaatgccgctatggttcaacttaagccatagcggtgacgatatcgccctgctgttgagtgatgaaggcgaagtcggctgcgatatcgaagtgattcgcccgcgcgccaactggcgctggctggcgaacgccgtattcagcctcggggaacacgctgagatggacgccgtgcatcctgatcagcaactggaaatgttctggcgcatctggacgcgcaaagaagccatcgttaaacagcgtggcggcagcgcctggcaaatcgtcagcgtagacagcacctatcactcctcgctgtcagtcagccattgtcagcttgaaaatttaagccttgcgatctgcacccctactccctttacgctcaccgccgacagtgtgcaatggatcgattcagttaactgatccgcccacccgactgcccatctattgatccagaacaggtaatcagtatgacgaatacttaaaatcgtcatacttatttccgccatctattttaatccattggggttaccatgctctccacactccgccgcactctatttgcgctgctggcttgtgcgtcttttatcgtccatgccgctgcaccagatgaaatcaccaccacctggccggtgaatgtcgggccactaaacccgcacctttacacgcctaaccagatgttcgcccagagcatggtttatgaaccattggtgaaatatcaggcagacggttcggtgatcccgtggctggcaaaaagctggactcattcagaagatggtaaaacctggaccttcaccctgcgtgatgacgtgaaattctccaacggtgaaccgttcgatgccgaggcggcggcagaaaacttccgcgcagtgctcgataaccgtcaacgtcacgcctggctggagctggcaaaccagattgttgatgttaaagcactcagtaaaacagagctgcaaattaccctgaaaagcgcctactatcctttcctgcaagaactggccctgccccgtcctttccgttttatcgctccctcgcagtttaaaaaccatgaaaccatgaacggaattaaagcgccgattggcaccggaccgtggattttgcaggaatcgaaactgaatcagtacgatgtcttcgtccgtaacgaaaactactggggcgaaaagccagcgattaaaaagatcacctttaacgtcatcccggacccgactacccgcgcggtggcgtttgaaactggcgatatcgacctgctgtacggaaacgaagggttattaccgctcgataccttcgcccgctttagccagaatccggcttaccacacccaactgtcacagccgatcgaaaccgtgatgctggcgctcaataccgccaaagcccccaccaacgagctggcagtacgtgaagctcttaattacgcggtaaacaaaaaatcgctgattgataacgcgttgtatggcacccagcaggtcgccgacaccctgtttgccccttctgtgccctacgccaacctcggcctgaaaccgcgccagtacgatccgcaaaaagcgaaagcgttgctggaaaaagccggttggacgctgcctgcgggcaaagacatccgcgagaaaaatggtcagccgctgcgcattgaactttcgttcatcggcaccgatgcgttaagcaaatcgatggcggaaatcattcaggctgatatgcgccagattggcgcagatgtctcgctgattggcgaagaagagagcagtatctatgctcgtcagcgcgacggtcgttttggcatgattttccaccgcacctggggcgcgccatatgatccacacgccttcctcagttcaatgcgcgtaccgtcacacgctgacttccaggcacagcaaggattagccgacaaaccgctgattgataaagagatcggcgaagtgctggcgacccatgacgaaacgcaacgtcaggcgctgtatcgcgacattctgacccgtctgcatgacgaggcggtttatctgcctatcagttacatctcaatgatggtggtatcaaaaccggagctgggtaacatcccctacgcgccgatcgccaccgaaattccgttcgaacagattaaaccggtgaaaccttaatgttgcgttacgtattacgccgctttctgctgctgatcccgatggtgctcgccgcctcggtgatcatttttctgatgctgcgcctcggtaccggcgacccggcgctcgattatttgcgtctgtctaacctgccgccgacgccggagatgctggcctctacccgcaccatgctgggactggatcagccgctgtacgtccagtacggcacctggttgtggaaggcgctgcatcttgactttggtatctcattcgccagccaacgcccggtactggacgatatgctgaacttcctgcccgccacgctggaacttgcaggtgcggcgctggtattaattctgctcacttccgtaccgctcggtatctgggcggcgcgccatcgcgaccgtctgccggatttcgccgtacgtttcatcgcgtttcttggcgtgtcgatgcctaacttctggctggcgtttttactggtgatggcgttttcggtgtatctgcaatggctacccgcgatgggttacggcggctggcagcacatcattttgcctgcggtttccattgcctttatgtcgctggcgattaacgcgcgtttactgcgcgccagtatgctggacgtcgccggtcagcgtcacgtcacctgggcgcgtctgcgcggcctgaacgacaaacagaccgaacgtcgccacatcctgcgcaatgcctcgctgccgatgatcaccgccgtggggatgcatatcggcgaactgattggcgggacgatgattatcgaaaacatctttgcctggccgggcgtcgggcgctatgcggtgtcggcgatttttaaccgtgactatccggtgatccagtgctttacgctgatgatggtggtggtttttgtggtctgtaatttgattgtcgatttgctcaacgccgcgctggacccgcgcattcgtcgtcatgaaggagcgcacgcgtgaactttttcctctcttcccgctggtcggtacgcctggcgctgatcattatcgccctgctggcgctgattgcgctcaccagccagtggtggctgccgtatgaccccctggcgattgatttgccgtcgcgcctgctttcgccggatgcgcagcactggctgggcaccgatcacttaggtcgcgatattttctcgcggctgatggcagcgacccgcgtgtcgctcggttcggtaatggcctgcctgctgctggtgctgacattagggctggttattggcggcagcgccgggttgattggcgggcgcgttgatcaggccaccatgcgcgtcgccgatatgtttatgaccttcccgacctcgattctgtcgttctttatggttggcgtgctcggcaccgggctgaccaacgtaattatcgccatcgccctgtcgcactgggcgtggtatgcacgcatggtgcgcagcctggtgatttcactacgccaacgcgagtttgtgctggcgtcacggctttccggtgcgggccatgtgcgggtgtttgtcgatcatctggcaggcgcggtgatcccttcgctgctggtgctggcaacgctggatatcggccatatgatgctgcacgtcgcggggatgtctttccttggcctcggtgtgaccgcgccgaccgccgaatggggcgtgatgattaacgacgcgcgccagtatatctggacccagccgctgcaaatgttctggccggggctggcgctgtttatcagcgtgatggcctttaacctggtgggtgacgcactgcgcgatcatctggaccctcatctggtgacggagcacgcacactaatgccgcaacagattgaactacgtaatatcgcgctacaggccgcgcagccgctggtacacggtgtatcgttaaccctgcaacgcgggcgcgtgctggcgttagtcggcggtagcggcagcgggaaatcattaacctgcgccgtggcgctgggaattctgcccgcaggcgttcgccagacggcgggggaaattttagccgatggcaaaccggtttcgccttgcgccctgcgcggcatcaaaattgccaccatcatgcagaacccgcgcagcgcctttaatccactgcacaccatgcacacccacgcgcgggaaacctgcctggcgttagggaaacccgccgatgacgctacgcttaccgctgccatagaagcggtggggctggaaaacgccgcgcgcgtgctgaagctgtacccgttcgagatgagcggcggcatgttgcagcgcatgatgattgcgatggcggtgctgtgtgaatcaccgtttatcatcgccgatgaaccgaccaccgacctcgacgtggtagcacaggcgcgcatcctcgatctgctggaaagcattatgcaaaaacaagcgccgggaatgctgctggtcacccatgatatgggcgttgtggcgcgtctggcggatgacgtggcggtgatgtcacaaggtaaaattgtcgaacagggcgatgtagaaacgctgtttaacgcccccaaacatacggtgacgcgcagcctggtttccgctcatctcgccctctacggtatggagctggcatcatgaccttacttaacgtctgcggcctttcccatcactatgcccacggtggatttagcggaaaacatcaacatcaggcggtgctgaataacgtttccctgaccctgaaaagcggcgaaaccgtcgccctgctgggacgcagcggctgcggaaaaagcaccctcgcgcggctgctggtaggcttagagtctccctcacaagggaatattagctggcgcggcgaaccgctggcgaaactcaatcgcgcccagcgtaaagcgttccgccgcgatattcagatggtatttcaggactccatcagcgccgtgaatccgcgcaaaaccgtgcgcgagatcctgcgtgaaccgatgcgccacctgctatcactgaaaaaatccgaacaactggcgcgcgccagcgaaatgctgaaggcggtcgatctcgatgacagcgttctcgacaaacgcccaccgcagttaagcggcggccagctccagcgcgtctgcctggctcgcgcactggcggtcgaaccgaaactactgattctggatgaagccgtttctaaccttgatctcgtgttacaggcgggcgtcattcgcctgctgaaaaagctacaacaacagtttggcactgcctgcctgttcatcacccacgacttacgcctggtggaacgcttttgccagcgagtgatggtgatggacaacggacaaatcgtcgaaacccaggcggtgggagataaattaaccttttcctctgacgccggacgtgtgctacaaaacgcggtattacccgcattccccgtgcgccgtcgcacctcagaaaaggtttaacgcaaatgcaacgagtcaccatcacgcttgatgacgatttactggagacgctggacagcctgagccagcgtcgtggttataacaaccgttccgaagctatccgcgatattctgcgtagcgccctggcgcaggaagctacccagcagcacggcacacaaggtttcgcggtgctgtcgtatgtgtatgaacacgaaaaacgcgacttagccagccgtattgtttccacccagcatcatcaccacgacctctccgtcgccacgctgcatgtgcacatcaaccacgacgactgtctggaaatcgccgtgttgaaaggtgacatgggtgacgtgcagcattttgccgatgacgttatcgcccagcgcggcgtgcggcacgggcatttgcagtgcttgccgaaggaagattgagtctattattgggtcctttggtgaacgatcaacaaagggccactagcacacctgattcctctctaaataccctatccgaaccttctcttttgtaacgttctaaatatattcctaaaaatcttcaattcattgtgaccacaagtttttcttcgctttttcgtatgaagatactgtcattaaaataatagaaaaggattttacgatgagcggaaaaccggcggcgcgtcagggtgacatgacgcagtatggcggtagcattgttcagggttcagccggggtacgtattggtgcccccaccggcgtggcctgttcggtgtgccccggcggggtgacgtccggccatccggtcaatccgctgctcggtgcaaaggtccttcccggtgaaaccgacatcgccctgcccgccccgctgccgttcatcctctcccgcacctacagcagttaccggacaaaaacgcccgcgccggtggggagcctcggccccggctggaaaatgcctgcggatatccgcttacagctgcgcgataacacactgatactcagtgataacggcggcagaagcctgtattttgagcacctgtttcccggtgaggacggttacagccgcagcgagtcactgtggctggtgcgcggcggcgtggcgaaactggatgaaggtcaccggctggccgcactctggcaggcgctgccggaagaactccgcttaagtccgcatcgttatctggcgacaaacagtccgcaggggccgtggtggctgctcggctggtgtgagcgggtgccggaagcggatgaggtgctgcctgcgccgctgccgccgtaccgggtactgaccgggctggtggaccgcttcgggcgcacacagacgttccaccgcgaagccgccggtgaattcagcggcgaaatcaccggcgtgacggatggtgccgggcgtcacttccggctggtactgaccacgcaggcgcagcgggcagaagaagcccggcagcaggccatttccggcgggacggaaccgtccgcttttcctgataccctgccgggttacaccgaatatggccgggacaacggcatccgtctgtctgccgtgtggctgacgcacgacccggaatacccggagaatttacctgccgcgccgctggtgcgctatggctggacgccgcgcggcgaactggcggcagtgtatgaccgcagcaatacacaggtgcgcagctttacttacgatgataaataccggggccggatggtggcgcaccgtcacacgggccgaccggaaatccgttaccgttacgacagcgacgggcgggtgacagaacagcttaacccggcaggcttaagctacacgtatcagtatgagaaagaccacatcaccatcaccgacagcctggaccgccgtgaagtgctgcacacgcagggcgaagccgggctgaagcgggtggtgaaaaaggaacacgcggacggcagcgtcacgcagagtcagtttgacgccgtgggcaggctcaggacacagacggatgccgcaggccggacaacagaatacagcccggatgtggtgacgggcctcatcacgcgcatcaccacgccggatggcagggcatcggcgttttactataaccaccacagccagttaacgtcagccaccgggcctgacgggctggaaatacgccgggaatatgatgaattgggccgtctgattcaggaaactgcccctgacggcgatatcacccgctaccgttatgataatccacacagtgacttaccctgcgcaacggaagatgccaccggcagccggaaaaccatgacgtggagccgttacggtcagttgctgagcttcaccgactgttccggttatgtaacccgttatgaccatgaccgcttcgggcagatgacggcggtgcaccgcgaggaagggctgagtcagtaccgcgcatacgacagccgtggacagttaattgccgtgaaagacacgcagggccatgaaacgcggtatgaatacaacatcgccggtgacctgaccgccgtcattgccccggacggcagcagaaacgggacacagtacgatgcgtggggaaaggccgtccgtaccacgcagggcgggctgacgcgcagtatggaatacgatgctgccggacgggtcatccgcctgaccagtgaaaacggcagccacaccaccttccgttacgatgtactcgaccggctgatacaggaaaccggctttgacggccgcacacagcgttatcaccacgacctgaccggcaaacttatccgcagcgaggatgaggggctggtcacccactggcactatgacgaagcagaccgcctcacgcaccgcaccgtgaagggtgaaaccgcagagcggtggcggtacgacgaacgcggctggctgacagacatcagccatatcagcgaagggcaccgggtgacggtgcattacgggtatgatgagaaaggccgcctgaccggtgagcgtcagacggtgcatcacccgcagacggaagcactgctctggcagcatgagaccagacatgcgtacaacgcgcaggggctggcgaaccgctgtataccggacagcctgcccgccgtggaatggctgacctacggcagcggctggctgtcaggcatgaaactcggcgacacaccgctggtggagtacacccgcgaccgcctgcaccgggaaacgctgcgcagcttcggccgttatgaactctccaccgcttacacccctgccgggcagttacagagccagcacctgaacagcctgcagtatgaccgcgattacacctggaacgacaacggcgaactcatccgcatcagcagcccgcgccagacccggagttacagctacagcaccaccggcaggctgaccagcgttcacaccaccgcagcgaatctggatatccgcatcccgtatgccacagacccggcaggtaaccgcctgcccgacccggagctgcacccggacagcaccctcagcatgtggccggataaccgtatcgcccgtgacgcgcactatctttaccggtatgaccgtcacggcaggctgacagagaaaaccgacctcatcccggaaggggttatccgcacggatgatgagcgcacccaccagtaccattacgacagtcagcaccggctggtgcactacacgcggacacaatatgcagagccgctggtcgaaagtcgctatctttacgacccgctgggccgcagggtggcaaaacgggtatggcgacgtgaacgggacctgacgggctggatgtcgctgtcacggaaaccggaagtgacctggtacggctgggacggcgaccggctgaccacgatacagaacgacagaacccgcatccagacgatttatcagccggggagcttcacgccactcatcagagttgaaaccgccaccggtgagctggcgaaaacgcagcgccgcagcctggcggatacccttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgactgtggagcagatgcaaaaccagatggacccggtgtacacgccggcgcgaaaaatccacctgtaccactgcgaccatcgcggcctgccgctggcccttatcagtaaggaaggggcaacagaatggtgcgcagaatacgatgagtggggcaacctgctgaatgaagagaacccgcatcagctgcagcagcttatccgcctgccggggcagcagtatgatgaggagtccggcctgtattacaaccgccaccgctattatgacccgctgcaggggcgatatatcactcaggatccgattggactgaaggggggatggaacctgtatggatatcaattgaatccgatatcagacatcgaccccctgggtttatctatgtgggaggatgcaaaatcgggggcatgtactaatggtctttgcggcacactatccgctatgataggtccagataaatttgattctatagatagcaccgcatatgacgccttaaataaaataaatagccaatctatttgcgaagataaagagttcgctggtttaatatgtaaggataatagtggcagatatttctcaacagcacctaaccgaggagaaagaaaaggatcatatccattcaatagcccttgccctaatggtactgagaaagtatcagcttatcatactcatggtgcagatagtcatggagaatattgggacgaaatattttcaggtaaagatgagaaaatagttaaaagtaaagataacaatatcaagtcattttatttaggtacgcccagtggtaattttaaagcaatagataaccacgggaaggaaataacaaacagaaaaggattacctaatgtctgcagagttcatggtaatatgtaaaaaatattgtttaggaactgtgtcattgtatctttgtttgtttttacatacaacacatgggcgcagtgtaataataatattaaaataatgcgcaagtatgaaagtgaaggtaaatataccgttagaaatttggttaaaaataaagctatagcattggaattagctgagatatatgttaagaatcgttatggacaggatgccgcagaagaagaaaaaccatacgaaataactgagttaacaacaagttgggttgttgaaggtaccattcactcagaccaaattgctggtggggtttttattatagaaataggcaaaaatgatgggagaattctgaattttggccacggaaaataagtatgtaaggataatcaaacatcgtgtgcgctgatggcagagtaggtggaggactccagacagtcaaacgatagaaaaagatagcctttatggaggttcctgcaatgtcaaatacataccagaaaagaaaggcaagtaaagagtatggtttatataataaatgtaagaaactaaatgatgatgaattatttcgcttacttgatgatcgcaattccttgaaaaggatttcatctgccagagtattacagttaagaggggggcaagacgctgttagattggcaattgaattctgcactgacaaaaattatatccgtagagatatcggagcatttatactcgggcaaatataaatttgcaaaaaatgcgaagataatgtttttaatattttgaacaatatggcattgaatgataagagtgcttgcgttcgagctacggcaatcgagtcaacggccagggaaagatcatcaaaagttcactttttgcactaaataattcgcattttatgtttaaaaattgagatattccttattacctgaagctgttttttattgcttatacatgatcaaatactccttacctaattaaggagaacaaaatggaacttaaaaaattgatggaacatatttctattatccccgattacagacaaacctggaaagtggaacataaattatcggatattctactgttgactatttgtgccgttatttctggtgcagaaggttgggaagatatagaggattttggggaaacacatcccgatgttttgaagtgatatggtgattttgaaaatggtattcctgttcacgatatcattgccagagttgtatcctgtatcagtcctgcaaaatttcacgagtgctttattaactggatgcgtgactgccattcttcagatgataaagacgtcattgcaattgatggaaaaacgctccggcactcttatgacaagagtcgtcgcaggggagcgattcatgtcattagtgcgttctcaacaatgcatagtctggtcctcggacagatcaagacggatgagaaatccaatgagattacagccattcctgaacttcttaacatgatggatattaaaggaaaaatcatcacaactgatgcgatgggctgccagaaagatattgcagaaaagatacaaaaacagggaggtaattatttattcgcggtaaaaggaaaccaggggcggctaaataaagcctttgaggaaaaatttccgctgaaagaattaaataatccagagcatgacagttacgcaatgagtgaaaagagtcacggcagagaagaaatccgtcttcatattgtttgcgatgtccctgatgaacttattgatttcacgtttgaatggaaagggctgaagaaattatgcgtggcagtctcctttcggtccataatagcagaacaaaagaaagagccagaaatgacggtcagatattatatcagttctgctgatttaaccgcagagaagttcgccacagcaatccgaaaccactggcacgtggagaataagctgcactggcgtctggacgtggtaatgaatgaagacgactgcaaaataagaagaggaaatgcagcagaattattttcagggatacggcacattgctattaatattttgacgaatgataaggtattcaaggcagggttaagacgtaagatgcgaaaagcagccatggacagaaactatctggcgtcagtccttgcggggagcgggctttcgtaatcttgccctgaatacaggactgagtatcaaaaagccggttaactgaaactgtccaggttttgggggtcagttcataaacgccttatccggcctaaaaacaactaaaattcaataaattgcaccgatgcgtagtccctataagcttacgcatcgggcaattgtatttacgccattgtcccaatcgtcttcctgaatcgcagcagtgcaatggtgaaaaacgcgccgccaattgccatcagcgtcaggaactgcggccagacgatttcgaatccggcaccccggtagaggatggcctgcgcgaggctaacaaagtgtgtcgtcggcatggtcagcatagtgtcctgcaccatctgcggcatactttcgcgcggcgtggatccaccggaaagcatttgcagcggcagcagcaccagaatcaccagcagccccagttgcggcattgaacgcgctatcgtccccataaaaatgccgattgacgtggtggcaaacagactgagcgccacgcccagcataaacagcgggatcgagccttcaatcggtacgcccagtacacctttcaccatcagcaccagcgataatcccgataccaccagcaccaccagccccatcgaccagatcttcgccatcatgatctcaaacggcgttatcggcatcaccagtaaatgttccaccgtgccgtgttcacgctcgcggatcagcgccgatccggtcaatacaatcgccagcatggtaatgttgttgatgatcgccatcaccccgccaaaccacgcgggatcaaggttcgggttaaagcgcatccgggtttccagcgataccaacggttcgctgttatcacggtagcgcgcgacaaagctgttcacttcaccgttgataatattctggatatacccattgccggtaaatgcctggctcatgcgcgtggcatcgacgttcacctgaatatccggctggcgtccggcgaggacatcacgctgaaaattaggcggaatatttatcgcgaaggtatagcgtccggcgtccagtccagcatccatctcatcggcggtgatcatctccggtggcaaaaaccacggacgatagaagctgttaacgatccggttcgataactgcgattgatccatatcggcaatggcgatcggcgcgaggttcaacgatcctggcgtaacggtcgctgacgaatacaccgacaccgtaaacgagaagacaatcagcgtcagcatcgctttatcaccgagcagactgcgcaactctttgatacccagattaaaaatattgcgtaaatggcgcatcatccctcctgttttttcagcagcaggatacttaagcccatcaccagcgggatggctatcagcaacgggataaaaagttgccacaaatcagtcagatccagcgctttcgagaacgtcccgcgggcgataatcagaaaatgactggtcgggtaaacctcgccgatccaacgtccaggcccttccagcgaagctaccggatcgatcatcccggaaaactgtgtcgccgggatcaacgtgataatcgccgttccgaaaatggcggcaatctggcttttcataaaggtggagatcagcagccccattccggtggcaatgatgatatacagcagcgccgccagggtgagcgtcaggaaactgcctttatgcggtacgccaaacacaaacaccgacaggccgcagagcaggaaaaagttcagcatccccagcgcgatgtatggcaactgtttaccaagcaaaaattcactacgcgtggtgggggtcacgtaaaggttgataatcgacccaagctctttttcccgcaccacgctaagggcgcttagcattgacgggatcatcatcagcagaagcgggatcaccgccggaacaatcgctggcaggctttttacgtccgggttatagcgataacgcgtctcaatgttcatcagcccgctttggctggcgggtgtcgattgtcggctcgccacatcctgaagccaactctggtgcattgcctgcacgtaaccttttaccgtttcggcacgactgggcatcgctccgtcgatccagacgccgagttccacaggcgtaccacgcgcgatatcgcgcccgaaattgggcgggatctcaatcgccaccgtgatatcgcccgcacgcatccgacgatcaagctcgtcataactggtgagcggcggctgttcgataaagtaacgggaaccggagaggttgagtgtccacgcctggctactgacggtctggtcgcggtcgagcaccgcaaagcgcaggttttccacatccatactgatgccgtaacccattatcagcatcaggatcaccgttcccatcagcgccagcgtcgaacgtactggatcgcgtcgcagttccagcgcttcgcggcggctgtagctaaacagacggcgcaggctaaatccctgacgcggcgcgtgggtggtgtcgtgtaccacgggcggcgcttcggcttcgttgctctgccctgccgcttcctgcaaataggcgataaatgcctcttccagactggcggctccgcgtttctcaaccagttcctgcggtgtaccgctggcaagcacttttccggcgtgcatcagtgagatgcggtcgcaacgttccgcttcgttcataaagtgggtggagatgaagatagtcactttgtcctggcgcgagagatcgaccatcaactgccagaacatatccctcgccaccggatcgacaccagaagtaggctcatcgaggattaacatctccgggcgatgaatcaccgccaccgccagcgaaagccgctggcgaatgccgagcggcaatgactccggcagaatatcttcaacgtcgttgagcttaaaacgctcgctcatttcagccactcttgcgggaatttccgcttccgggatgtgaaacaaacgggcatgtaactcaaggttttgccgcacggtgagttcgttatagagcgaaaacgcctgcgacatatagcccacccgacggcgggtatcgatatcttttggatcaaccggttgcccgaacagccacgcctcaccttcgctggcgggcagcagtccggtgagcattttcatggtggtggatttaccgcagccgttcgaaccaagaaaaccaaaaatctccccgcgtggaatgcggaaattaacgtgatcaacggcaacgaaggaaccaaaacgcatggtcagatcgcgcgcttcgatggcaatctctgcgttttcaggttgatacggtgggatcactaccgcctgatgcgcctggcgttgcgcttgcggtaacagatttataaatgcttcttccagcgtagcgctttgcgtttgctgccgtagctcttcggcgctgccagttgccagcacttctccggcattcatcgctaccagccagtcgaagcgttcggcctcttccatataggcggtggcgaccagcacgctcatattgctctgccgctggcgaatactgtcgatcagatcccagaactgggagcgggagagcgggtcaacccccgttgttggctcatcaaggatcaacagttccgggtcgtggattaacgcgcagcacagcccaagtttttgcttcatcccgccggagagtttccctgccggacgatcgcgaaacggtgctaaccccgtgctggtcagcagctcattaattcgcacttcccgctccgctttgtcgtgaccgaacaggcgagcgaaaaaatcgacgttttcatacaccgacaaggtgtggtagaggtttttgcccagcccctgcggcatccaggcgatgcgcgggcagacgtctcggcgatgcttcgggtcgtgcatatcgccacccagcaccaccacattgccctgctcaatgacgcgggcaccggaaatcagtgacaataaactcgacttcccgacgccatccggaccaatcagcccgaccatgcaacgggccggaatatcgagagtgatattgttcagcgcaacggtttttccataatgctggctcacgcccgccagttgcgcgacaggcgggacgggaaccagttccagatgagtcattgcggcaacctcaccacgaggtcgtcaggccacggaagttcttcattcacccgcacccacgctacgcccggtaaaccggttttgacatattccagatgctgctggagtaattccggtgggatacgcgctttgacgcggaacatcagtttcagccgttcatcgctggtttcgacggtttttggcgtgaactgggcgacactggcgacaaaactgatggtcgccggaatacgcagatctggcgcggcatcgaggatcagccgggcttcaccgccaagtttcagcgtgcccgcctgttcggttggcaggaagaaagtcatatagacgtcgctgagatcgaccatattcagcacccgaccgcctgccgccagcacttcccctggctcggcaacgcgatattgtacgcgtccatcacgcggggctttcagttcgctgtcatcgatatctgcggcaatgcgccgttcagtggcttgtgcggcttcgacgcgagtttgcgcctgaatgatattggtgcgtgccgcttctatagccgctttagaagccgatacctgagctttcgccgattccagcgcagctcgggcgctctcagcggcggcgcgatcgtcatccagctgttgcgcagaaatagcccctcgttgggcgagcgagcgggaacgcgtatgacgtttagccacggagtccagttcggcctggcgttgattaaccagcgactgcgcggcacgagtttcgctttgccgttgctccagcaaagcctgcgcggcagcaacggcactttgtgctgctttgatttgcgcgatggcttccagtcgctgttcctgcaacacgcgagtatccatcttcgccagcacttcgccttcgcgaacaaactggccttctttcaccagaatggtgtcgatacgcccggcaattttgctggcgatatccacttccgtcgcttcaatgcgcccattgctgacggcaaagccttccggcacacctgccgggcgcaacagccaccacgccacgatagccgccaccgccagtaacccgacaacccaccacgccagatggcgcttactcttatccataatcgacccgccataatccctgtaagcaaacgacgcgtgttacaactgccgccgaacgacgttcagcggattcttccatccgggataagaaggaaacgacaaatacgaccagcgcgcagagcattgagcgccaacggggaaggcttagtgaaaacgggtagtaatgttgtcatcatcagcattcctggccgtaaatgaaacacgcatactcataagtgtgatctataaaactggctgacaaaacggtatccatcctgttggatagcgtttcacgcctgttcagttgcaggaacagagcattcctttttacgttttatcaacagtctcaaccagatagtaacattaatattcatgttgtctatggttcagagctgtaacattgtgcgccttctgatcaaaggcataagtccatttctgtttttttcatgctggtaagacttccagggagtggttatctcaggccctgcaccagggttaatttggcaattatgcatgctgaacattcttccagcatgtttactgtcacgggcgttaagacctaaaactgtccccgtttcacctatacattctcttccaccattaccgttatgtgcaacaacttgatttatacctaacatttgtgagcatgctaatagtgcttcaagtttaggtctgtaatctgtcgaaacagaaaaataacgattaaaggatcgacggtgatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctatctctgctctcactgccgtaaaacatggcaactgcagttcacttacaccgcttctcaacccggtacgcaccagaaaatcattgatatggccatgaatggcgttggatgccgggcaactgcccgcattatgggcgttggcctcaacacgattttacgtcacttaaaaaactcaggccgcagtcggtaacctcgcgcatacagccgggcagtgacgtcatcgtctgcgcggaaatggacgaacagtggggctatgtcggggctaaatcgcgccagcgctggctgttttacgcgtatgacagtctccggaagacggttgttgcgcacgtattcggtgagcgcactatggcgacgctggggcgtcttatgagcctgctgtcaccctttgacgtggtgatatggatgacggatggctggccgctgtatgaatcccgcctgaagggaaagctgcacgtaatcagcaagcgatatacgcagcgaattgagcggcataacctgaatctgaggcagcacctggcacggctgggacggaagtcgctgtcgttctcaaaatcggtggagctgcatgacaaagtcatcgggcattatctgaacataaaacactatcaataagttggagtcattacctgggagcggtatgctttacgttgttctcaatcgtttcaatattagaagcaggttctgctaaaaaataattgcaacgtaccggataaaaccagcgttgaccatttgcgtaacgctggtttttcttaggcatcatgaaataacgcagcattaatgcatagtggttaaggataaaaaaacaacaaagttactgtctttttcagcctgttcatattttataaagatctggccactgggtgagttttcaatcacctttccttccaccttatattaagcctggagggtttcagttcacgggctcattagaaaataatcacaagatagccactatcaaaattagctcatttttaatgcggctctaataattttcatctttaggtaacaggtcaggacgacttcgctgcaatcaaatcctgcgcacaagcccatgcactcgaccacgcccactggaagttatagccccccagccagccggtgacgtccatcacttcgccgatgaagtacagcccaggcactttgcgcgcttccatcgtccgtgaagagagttcgttggtgtccacgccgccgagcgtcacttcggcagtgcgatagccttcagtgccgttgggttgtacgcgccagtcggtcaatgtgctaatcagtgcctgttggtcacgcacgttgagctgttttagcgaaacatccgggatttgcccgagttgctgtaagcgttcaaccaaccgcttcggtagatgaaccgccagtgtgtttttcaggctctgattcggatgtgcgttacgctgctcattcaggaaggtttcgaggtccacatcaggtagcagattgatactgacaaattcacccggttgccagtagcttgaaatctgcaacaccgccggtccagacaagccgcgatgggtgaagagtaagttctcacggaaaacgatgccgttttcagcggtaatcacggaaggcaccgccacgcccgccagcacctgtaactcttcgagcaacggtttatgcagagtgaatggcaccagacccgcacgggtcggcagcacgttgaggccaaattgttcggcaatcttataaccaaacggcgacgcgcccagccccggcattgacagcccaccggtcgcgatgaccagcttttcgcaaccgacagtcatgccgttcagttcaagcgtgaagcctgtttcatccttcgccacactcagcacttcgctacgcaatctgaaggttacattgcccttctcgcactcatccaccagcatgtcgacaatctgctgcgcggagtcatcgcagaagagttgtcctaacgttttctcgtgccaggcgatgccgtgtttattgaccagatcaatgaaatcccactgggtaaaacgcgcgagtgcagacttacaaaaatgcggattctggctcagataagcgcctggttcgacataaaggttggtaaagttgcagcgcccaccgccagacataaggattttgcgccctggttttttaccattatcgatcagcagaacccggcgtcctgcctgacctgccagcgcagaacagaacatacccgccgcaccagcgcctataataatggcatcaaacctttccacgttgcgctcctcttagaaaaaacgggcgtgaattgtaaagattcctcagtggtcgcaccagcatcaatattactaaaaggaagtatttgcctgaattatataagataattattttttgagtgaaatccatacaggaggcaaatcaaaaaaagtctatatttcactttgcccgcgccgcgaaagtcactgataatgcgccgcgttcatgtcctcaaaatggcgtaacgtcctatgctacatttgtttgctggcctggatttgcataccgggctgttattattgcttgcactggcttttgtgctgttctacgaagccatcaatggtttccatgacacagccaacgccgtggcaaccgttatctatacccgcgcgatgcgttctcagctcgccgtggttatggcggcggtgttcaactttttgggtgttttgctgggtggtctgagtgttgcctatgccattgtgcatatgctgccgacggatctgctgcttaatatgggatcgtctcatggccttgccatggtgttctctatgttgctggcggcgattatctggaacctgggtacctggtactttggtttacctgcatccagctctcatacgctgattggcgcgatcatcgggattggtttaaccaatgcgttgatgaccgggacgtcagtggtggatgcactcaatatcccgaaagtattaagtattttcggttctctgatcgtttcccctattgtcggcctggtgtttgctggcggtctgattttcttgctgcgtcgctactggagcggcaccaagaaacgcgcccgtatccacctgaccccagcggagcgtgaaaagaaagacggcaagaaaaagccgccgttctggacgcgtattgcgctgatcctttccgctatcggcgtggcgttttcgcacggcgcgaacgatggtcagaaaggcattggtctggttatgttggtattgattggcgtcgcaccagcaggcttcgtggtgaatatgaatgccactggctacgaaatcacccgtacccgtgatgccatcaacaacgtcgaagcttactttgagcagcatcctgcgctgctgaaacaggctaccggtgctgatcagttagtaccggctccggaagctggcgcaacgcaacccgcggagttccattgccatccgtcgaataccattaacgcgctcaaccgcctgaaaggcatgttgactaccgatgtggaaagctacgacaagctgtcgcttgatcaacgtagccagatgcgccgcattatgctgtgcgtttctgacactatcgacaaagtggtgaagatgcctggcgtgagtgctgacgatcagcgcctgttgaagaaactgaagtccgacatgcttagcaccatcgagtatgcaccggtgtggatcatcatggcggtcgcgctggcgttaggtatcggtacgatgattggctggcgtcgtgtggcaacgactatcggtgagaaaatcggtaagaaaggcatgacctacgctcaggggatgtctgcccagatgacggcggcagtgtctatcggcctggcgagttataccgggatgccggtttccactactcacgtactctcctcttctgtcgcggggacgatggtggtagatggcggcggcttacagcgtaaaaccgtaaccagtattctgatggcctgggtgtttacccttccggctgcggtactgctttccggcgggctgtactggctctccttgcagttcctgtaatcgtacacaccaaaacgagcgggtcagctggcccgcttcagattgttgacatagtgcgctttgttcatgccggatgcggcgtgaacgccttatccggcctacaaaaacatgcaaattcaatagattgcagagattatgtaggcctgataagcgtagcgcatcaggcaattttgcgtttgtaatcagtctcgagcgggtcagtttactggcccgctttttttatacgttattattgctgaagtgcttaatgccaaatcatcaatgcaatcaggctgaccaccaccagaccacacaatgcgctggtcagaataaactgccgacgcacccgctcacagcggcgaataaattcatcatcgtgatgatcgcgataacgttgggcatagatataccaaacgagacgcacctgtttgttgggttggccatgtgaggtaaaaaagccccctccatcaacatattgatagagcaatggatcgcagttacgcagtaccactaacaacgcgcgtagtgatgagaaatagcgcgccatgttaacaatgcaaacgacacataaagcccaaaataatgcgacggtgcttatcatacctcctccccggcgacctgcccgcggagttccaccccggggctaccgctcccgatacgctgccaatcagttaacaccaggtcctggagaaaccgcttttgtggtgaccaacatccgagcggctctatagatagtgtaggagatcaggttgttttttttccagaaggttaaccactatcaatatattcatgtcgaaaatttgtttatctaacgggtaagcaaggcggattgacggatcatccgggtcgctataaggtaaggatggtcttaacactgaatctttacggctgggttagccccgcgcacgtagttcgcaggacgcgggtgacgtaacggcacaagaaacgctagctggccagtcatcgacaactttatggaaggagtaacactatggcttataaacacattctcatcgcggtcgatctctccccggaaagcaaagttctggtagagaaagcagtctctatggctcgcccctacaatgcgaaagtttctctgatccacgtagatgtaaactactctgacctatacaccgggcttattgatgtgaatctgggtgatatgcagaaacgcatctcagaagagacacatcatgcgctgaccgagctttccactaatgcaggctacccaatcactgaaaccctgagcggcagcggcgacctgggccaagttctggtcgatgcaatcaagaaatacgatatggatctggtggtttgtggtcaccaccaggacttctggagcaaactgatgtcttccgcacgtcagctgatcaacaccgttcacgttgatatgctgattgttccgctgcgcgacgaagaagaataatcttccctctacgacgtgttcctgaacgcccgcatatgcgggcgttttgctttttggcgcgccttgttacctgatccagcgtaaacaccttatctggcctacggtctgcgttcgcaatcaaaatccccagccaatacaatatttaacaccatcatattttccatcattagtgtgatcagctggttattttctgttgtaatagtgtattaatctattcaccgcatcaatattaagaatctctgacagatgtaaactttttcgcgcgttatcccttacgcgttcatacttttcaggatggtattggaaggttaataaatatgaatacaacaacacccatggggatgctgcagcaacctcgcccatttttcatgatcttttttgtcgagttatgggagcgattcggctactacggcgtgcagggcgtactggcggttttcttcgttaaacagcttggattctcgcaagagcaggcttttgtcacttttggtgcttttgctgcgctggtctatggcctcatttccattggcggctatgtcggcgaccacctgctggggaccaaacgcaccattgttcttggtgcacttgtgctggcgattggctacttcatgaccggcatgtcgctacttaagcctgacctgattttcatcgccctggggactatcgctgtaggtaacggcctgtttaaagctaacccagccagcttgctttcgaagtgctatccgccgaaagatccgcggcttgatggcgcattcaccctgttctatatgtcgatcaacatcggctcgttgatagcgttatcgctggcccctgtgatcgctgatagattcggttattcagtcacctacaacctgtgcggggcggggttaattatcgcattactggtttacatcgcctgtcgtggaatggtgaaagacattggttctgaacccgacttccggccaatgagcttcagcaaactgttgtacgtgttacttggcagcgtggtgatgatcttcgtatgcgcatggctgatgcacaacgtagaagtcgccaatctggtgctgattgttctctccatcgtcgtcaccatcatcttctttcgtcaggcattcaagctggataaaaccgggcgcaataaaatgtttgtcgcctttgtcctgatgctcgaagcggtggtgttttacattctctacgcccagatgccaacatcgctgaacttctttgccatcaacaacgtgcatcatgaaattctcggtttttccatcaacccggtcagcttccaggcgcttaacccgttctgggtggtactcgccagcccaatactggcaggcatttacacgcatctgggtaacaaaggcaaagacctctcgatgccgatgaaatttactctcggcatgtttatgtgctcactgggctttttgacggcggcagctgcgggaatgtggtttgcggatgcacaagggctgacatcgccatggtttatcgtgctggtgtacttattccagagcttaggtgaactgtttattagcgcccttggcctggcgatgattgctgccctggtgccgcagcatttgatgggctttattctcgggatgtggttcctgacgcaggctgccgcgttcttgctgggcggctatgtggcaacatttaccgcggtgccggacaacattaccgatccgcttgagacgttgcccgtctataccaacgtgtttggtaagattggtctggtcacgctgggcgttgcagtagtgatgctgttgatggtgccgtggctgaaacgcatgattgcgacgccggaaagccattaattattcttgcagaaagcagggtagcgttatcgctaccctgttttagttttacactggcgtacctgcatagatatcaaagcgatgccctttagtgactaccgcgtttggcgtggcgacattcgccagcggtggcgcgtagtccgggcgctttaccaccacgcgtttggtcgccagcaagcgtgcaggctccagtaatccatcggcatcaagatccggtcccaccagcgactgaaagacacgcatctcttttttcactagcgcgcttttctgcttatgcgggaacatcgggtcgagataaaccacctgcgggcgcggggtaatatcagtcagcgccgtcaggctggaggcgtgaattaactgcaaccgctcctgcaaccagccgccgatttccgcatccgcataaccacgcgccaggccgtcgtcgagtagcgcggcaaccactggattacgctccagcatccgcacgcggcagccgactgaagccagtacaaaggcatcgcgcccaagtcctgcagtggcatccaccacatccggcaaataatcgcctttaatgcccaccgctttcgccaccgcctcaccgcgaccaccgccgaatttgcgtcggtgcgccatcgctccgccaacaaaatcaacaaagatgccgccaagttttggctcatcacgcttgcgcaattccagatgttccggcgttaacaccagcgccatcaggttgtcttcatcgtgctccagcccccagcgggccgccagaacagataaggcaccgtctccggtgcctgtttcatcaattaagcagattttcactgaatgatcagcccttaatgccgtaatgctccagcatcgcatccagctgcggttcacgaccacggaagcgtttgaacagatccatcggctcttctgaaccgccacggctcagaatgttgtcgaggaacgactgcccggtttcacggttgaaaatgccctcttcctcaaagcgcgagaaagcatctgccgccagtacgtcagcccacaggtagctgtagtaacctgcggcataaccaccggcgaaaatatggctgaaagcgtgcgggaaacggccccaggacggagatggcaccacggcaaccagtttcttgatttctgccagagtttcgaggatttttgccccctgatccgggcggaactcggcatgaaggcggaaatcaaacaggccgaactccagctgacgcagaataaacagcgccgcctggtagttcttcgccgccagcattttatccagcaactctttcggcagcggttcgccggtttcatagtgaccagagataaacgccagcgcctccggctcccagcaccagttttccataaactgactcggcagttcgaccgcatcccacggcacaccgctgataccggaaacaccagcggtttcgatgcgggtcagcatatggtgcaggccgtgaccgaactcgtggaagagggtgatcacttcgtcgtgagtgaacagcgccggtttaccatttaccgggcggttgaagttacaagtcaaatacgcgaccggtttttgcaaagaaccatcagctttacgcatctggcctacgcagtcatccatccacgccccgccgcgcttgttttcacgggcatacagatcgaggtagaagctaccgcgcagttcgttattttcgtcatacagttcgaagaaacgtacatccggatgccagacatcaacatctttacgctctttagcggtgatgccgtaaatacgcttaaccacttcaaacaggccgttaaccgctttgttttccgggaagtacggacgcagctgttcgtcactgatgctgtagaggtgctgtttttgtttttcgctgtagtaagcgatatcccacggctgcaactcatcgacgccaaattcggctttggcaaaggcacgcaattgcgccagctctttttcgccttgtggacgcgcgcgttttgccagatcggttaagaaatccagcacctgctgcgggttttctgccattttagtggcaagggatttaaaggcgtagttttcaaagcccagcagttgcgccagttcgtgacgcagcgcgaggatctcttccatcaccttgctgttatcccatttaccggcgtttgggccttgatcggaggcgcgggtgctgtaagcgcgatacatctcttcacgcagagcctggttgtcgcagtaggtcattaccggcaagtagcttgggatatccagcgtcagcaaataaccttccagctctttcgcttcggcctgggcttttgccgcagccagcgcgctttctggcatccccgccagctccgcttcgtcggtaacgagtttggtccagcccattgtcgcatcgaggacgttgttgctgtactggttgcccagttcagaaagacgggtcgcaatttcgccgtaacgctgctgtttctctttcggcagacctatgccagagagttcaaagtcgcgcagtgcgttatcaaccgctttcttctgcgccgtgttcagcgtggcgtaatgatcgccatcgcgcaggtcgcgatacgctttatacagcccttcatgttgccctacccaggtgctgtattccgacagcagcggcagggtttgttcgtaggcttcacgcagttccgggctatttttcaccgagttcaggtggctgaccggggagaagatacgccccaacacatcgtccacttccgccagcggctggcagagattttcccaggtgtacggtgccccttgcgctactacgcgctccacgttttcgcggcagtcgttcaatgccttagtcacggctggaacgacatgttccgggagaattttagaaaacggaggcaattcaaagggagtcagtaacggattcgtcattcgcgcagtcctggttaaagaggttaaggaagcgctcaacaggcgctttacataatgtgtgtagcatggggttaagtgtagtgaatttcaatgagaaacgttacgctttcgcggcggcggcctcttttcggtatactgtcctgatacgcttttgtgcgccccgaatacgggccgatttttacttaccggaacacctttacccatgctcagttatcgccacagctttcacgctggcaaccacgccgacgtccttaaacataccgttcagagcctgatcatcgagtcgctgaaagagaaagataaaccgtttctctatctcgacacccacgcaggggccgggcgttatcagttaggcagcgaacatgccgagcgtaccggcgaatatctcgaaggcatcgcccgtatctggcagcaggacgatttgcccgcagaactggaggcgtacatcaatgtggtaaaacacttcaaccgtagcggtcagttgcgttactaccccggttcgccgttgattgctcgcctgctactgcgtgaacaggacagcctgcaactgaccgaactgcacccgagcgattacccgttgttgcgttctgaatttcagaaagatagccgtgcgcgtgtcgaaaaagccgacggtttccagcagcttaaggccaaactgccgccggtttcccgccgtggtttaatccttatcgacccgccgtatgaaatgaaaactgactatcaagcggtggtcagcgggatagcagaaggttacaaacgtttcgccactggtatttacgcactgtggtatccggtggtgctgcgtcagcaaattaagcgcatgatccacgatctggaagcgaccggtattcgcaaaattctgcaaattgaactggcggtactgccagacagcgatcgccgtggcatgaccgcttccggcatgattgtgattaacccgccgtggaaactggaacaacagatgaataacgtgctgccgtggctgcacagcaaactggttccggcaggcaccgggcacgccaccgtaagctggatcgtgccggagtaattgcagccattgctggcacctattacgtctcgcgctacaatcgcggtaatcaacgataaggacactttgtcatgactaaacactatgattacatcgccatcggcggcggcagcggcggtatcgcctccatcaaccgcgcggctatgtacggccagaaatgtgcgctgattgaagccaaagagctgggcggcacctgcgtaaatgttggctgtgtgccgaaaaaagtgatgtggcacgcggcgcaaatccgtgaagcgatccatatgtacggcccggattatggttttgataccactatcaataaattcaactgggaaacgttgatcgccagccgtaccgcctatatcgaccgtattcatacttcctatgaaaacgtgctcggtaaaaataacgttgatgtaatcaaaggctttgcccgcttcgttgatgccaaaacgctggaagttaacggtgaaaccatcacggccgatcatattctgatcgccaccggcggtcgtccgagccacccggatattccgggcgtggaatacggtattgattccgatggcttcttcgcccttcctgctttgccagagcgcgtggcggttgttggcgcgggttacatcgccgttgagctggctggcgtgattaacggcctcggcgcgaaaacgcatctgtttgtgcgtaaacatgcgccgctgcgcagcttcgacccgatgatctctgaaacgctggtcgaagtgatgaacgccgaaggcccacagttgcataccaacgccatcccgaaagcggtagtgaaaaatgccgatggtagcctgacgctggagctggaagatggtcgcagtgaaacggtggattgcctgatttgggcgattggtcgcgagcctgccaatgacaacatcaacctggaagccgctggtgtaaaaaccaacgaaaaaggctatatcgtcgtcgataaatatcaaaacaccaacgttgaaggtatttacgcggtcggcgataacacgggtgcagtagaactgacaccggtagcagttgcagcgggtcgccgtctctctgaacgcctgtttaataacaagccggatgagcatctggattacagcaacattccgaccgtggtcttcagccatccgccgattggtactgttggtttaacggaaccgcaggcgcgcgagcagtatggcgacgatcaggtgaaagtgtataaatcctctttcaccgcgatgtataccgccgtcaccactcaccgccagccgtgccgcatgaagctggtgtgcgttggatcggaagagaagattgtcggtattcacggcattggctttggtatggacgaaatgttgcagggcttcgcggtggcgctgaagatgggggcaaccaaaaaagacttcgacaataccgtcgccattcacccaacggcggcagaagagttcgtgacaatgcgttaaatgttaaagggctaagagtagtgtgctcttagcccttaattacgtttccgctatcagttcagaagctgaagcagaaagcggatcagttccagcagcgcaattaacgcccctagaacgatgattgctttatcaatcacccgttttctccatgcgatggagtgagaatgcatccgcttactcatccactgcctgtcacggcgcatgtctcattgttagataagaactctctcactccggccagagcatcagttaacggcaccacccgtacttctgaccaggactttgaaagcgtttatgcgcattgccagagtgaaaatgcctcagagctaactggataatcatacagtacatgcaggttataaaaccagcacgtccttgcaatagtttcagtatggtattagcattgatgcgttagatgatggctatctcactccagtcagagccaccaactcagggctggaaagtaaaaaaccgacgcaaagtcggtttttttacatccggattcggacaaggcttaatatgacgatgacccagtgaaagtatataaatcgtcactgcgatatataccgaagtgctccctccgccagctgaagaaatcgctaattcttgcaatgttagccactggctaatagtattgagctgttagataagaactctctcactccagccagagccaccaactcagggctggaaagtaaaaaaccgacgcaaagtcggtttttttacgtcctgattcagacctcctttcaaatgaatagccaactcaaaattcacacctattaccttcctctgcacttacacattcgttaagtcatatatgtttttgacttatccgcttcgaagagagacactacctgcaacaatcaggagcgcaatatgtcatttctgttacccatccaattgttcaaaattcttgctgatgaaacccgtctgggcatcgttttactgctcagcgaactgggagagttatgcgtctgcgatctctgcactgctctcgaccagtcgcagcccaagatctcccgccacctggcattgctgcgtgaaagcgggctattgctggaccgcaagcaaggtaagtgggttcattaccgcttatcaccgcatattccagcatgggcggcgaaaattattgatgaggcctggcgatgtgaacaggaaaagattcaggcaattgtccgcaacctggctcgacaaaactgttccggggacagtaagaacatttgcagttaaaaatttagctaaacacatatgaattttcagatgtgttttatccgggaggcattatgttactggcaggcgctatctttgtcctgaccatcgtattggttatctggcagccgaaaggtttaggcatcggctggagtgcaacgctcggcgcagtactggcgttagttacgggcgtggtccatccgggtgatattccggtggtgtggaatatcgtctggaacgcgacggctgcgtttatcgccgtcattatcatcagcctgctgctggatgagtccggcttttttgaatgggcggcgctgcacgtctcacgctggggtaatggtcgtggtcgcttgctgtttacctggattgtcctgctcggtgctgccgttgccgccctgtttgccaatgatggcgcggcgcttattttgacaccgattgtcatcgccatgctgctggctttagggttcagtaaaggcactacgctggcgttcgtgatggcggccggattcattgccgataccgccagcctgccacttattgtctccaacctggtgaatatcgtttccgctgatttctttggcctcggctttcgcgaatacgcctcggtgatggtgccggtggatatcgccgcgattgttgccacgctggtgatgctacatctctattttcgcaaagatattccgcagaactacgatatggcgctgctgaaatctcccgcagaagcgatcaaagatcctgctacgttcaaaactggctgggttgttttactgcttctgctggtgggatttttcgtcctggaaccgctcggcattccggtgagcgccattgcagctgtgggcgcgctgatattatttgtcgtcgctaaacgcggtcatgcgattaatacgggtaaagtcctgcgcggtgccccctggcagattgtcatcttctcgctcggcatgtatctggtggtttatggcctgcgcaatgccggattaacggaatatctttctggcgtactcaacgtgctggcggataacggcctgtgggccgcgacgctcggcaccggattcctcaccgccttcctctcttctattatgaacaatatgccgacggtactggttggcgcgttgtccattgatggcagcacggcatctggcgttatcaaagaagcgatggtttatgccaatgtgattggctgcgatttgggaccgaaaattaccccaattggtagcctggctacgctactctggctgcacgtactttcgcagaagaatatgactatcagctggggatattacttccgtacagggattatcatgaccctgcctgtgctgtttgtgacgctggctgcgctggcgctacgtctctctttcactttgtaatgagatactgatatgagcaacattaccatttatcacaacccggcctgcggcacgtcgcgtaatacgctggagatgatccgcaacagcggcacagaaccgaccattatccattatctggaaactccgccaacgcgcgatgaactggtcaaactcattgccgatatggggatttccgtacgcgcgctgctgcgtaaaaacgtcgaaccgtatgaggagctgggccttgcggaagataaatttactgacgatcggttaatcgactttatgcttcagcacccgattctgattaatcgcccgattgtggtgacgccgctgggaactcgcctgtgccgcccttcagaagtggtgctggaaattctgccagatgcgcaaaaaggcgcattctccaaggaagatggcgagaaagtggttgatgaagcgggtaagcgcctgaaataaagcggcgatatcccccccacaggttgttagaaaagtgcgctttatttatgtcggatgcgacgctggcgcgtcttatccgacctacaaagttatgaaaattcgatgaatagtatgttatttgtaggcctgacaggcgtagcgcatcaggcgattttgctatttacacagtactccctgcgtgagattccaattatcgcgtccagcatggtgtatcagtgagctgcttagttatcagcgatacagcgcagtagtttaaagacgtactggattatgatttatcagtggtttacacaacaaattattaaataattataagataccttaacccattttattattacacatctaaaacatcacaaaaaaaatcacttcacacactatcagagaacataataactttttaaaatgagcgcattttgatagttgttaacgatttcctttacgatactatcactaccctttttttacacacaaatattaccgggtggagataaaagggaaatcaaaggtaattatatcaggaagatataacgcattacatttattgtgtgtagaagaaaatccattcctgttctaattatccaatttaaacatcttagcataaaacaaatgatgaataaggaattttatgtcaattgactttaccccaggtataataaatacatatcacggcgatatttataactgcacaacaaataccgataatgctaaaacgccagacacaccgaagtggccttgcgataattgggaagaacaacaacccattaattccacattctctggagaaggatatatctctgatcaatatgatttagcgcaacaccaacttcaacaaattaatgcgtgccacacgaacactacatatacaaatgcagactactcaaaagttgtggctcaacttgtaagtcttattactaacattgaaacgataagttcgacacaacttacgcaacagacacaatcaatacttaatcagattaataacattagatatgaaaaaaacaaaagtgctgaatgtcgaatcattgttgtcgctaatcctaaacccgacaaggcaatcataactaaaattagcgtagaagagggaatacccataacattcagtgtccaaaccatgttttcagatactaattttattgctgaacaacgagctgacttaccaactaatataaaagatattcaaagcctgtatcaaaaaatgacgaagttatatattgagcacagtgaaaataaaaacaggatgaaagtctttgccggaaccaactttattgatttcaatatgacaggacagaacctgtccgggttcgttctaaccttgtcaaggttttatttcgaagatctacttaatataaatttcactgacgcaaatttaggtgacactatttttttacataaagaacaccctacccccaaattatataaagatggacaatatcttgacaaacaaatcgaaggtttattttcaacattattaaccattaatgacaaccttttacgagcaaaagcggaaattgcttcgacaataattaaatttttagaggccaggataaccaatctttcatacaatgacatattaaaatatcagcaagaattccaaaaacaatgttataagcaagttaaagcctttacgacactctcccgatacaataaaattcaaacatgggcagaaatgtctgaatatcaattcgaagtatttcaatacgagacgcttaacccaaaaaaatgtcacacacgccttatttaaagaggccactgcctaatgaaaaagatataaattatggggtggaaatagaaataccatctggtaaaagaattcgcttatcaaatcattaccagaatataataccataatattgattattagcactttataatcattgaataaaaatagattttatgtacttttaaaacaatgcactatattatggggtgatggatattcatgtcacgccccaaaattaactgagttcacctaaacagaaaggatataaacatcagacaggtttacgttactatcaggcatatcacctcagaatcagatgaaaactataaagaaatatctattatggttttaatatttgttgataaggatagtaacatgaacatgacaaaaggtgcactcatcctcagcctttcatttttgcttgccgcatgtagttcaattccgcaaaatatcaaaggcaataaccaacctgatattcaaaaaagttttgttgctgttcataaccagccggggttatatgttggtcaacaagcgcgctttggtgggaaggttatcaacgttatcaatggcaaaacggatacgttgttagaaatcgctgtattaccgttggatagctatgcgaagcctgatattgaagccaactatcagggccgactgctcgccagacaaagcggcttccttgatccagtgaactatcgtaatcactttgttaccatcctcggcaccattcagggtgaacaacctggctttatcaataaagtcccgtataacttcctggaagtgaatatgcagggcatccaggtgtggcatttgagagaagtggttaataccacctataacctgtgggattacggctatggtgcattctggccggaaccgggctggggtgcgccttactacaccaatgcggtgagtcaggtaacacctgagctggtcaaataacaccaccgaaagatgcagatgctttctcagcatctgcatcatgcattacatcaaattaatacacagtaagctaactattattattataagccctgtcctgttaattacctttggcaaactgattataaagttaatgtccgcaccaggagtcggttatgtttcttataattaccagggatacgatgttcttcaccgcgatgaaaaacattctgagtaaaggtaatgtcgttcatatacagaacgaagaagagatcgacgtaatgttgcatcagaatgccttcgtcattattgatacattaatgaataatgtatttcattctaattttctcactcaaattgaacgattaaaacctgtccatgtcattattttctccccctttaatattaaacgctgcctggggaaagtgccggtgacctttgttccgcggactatcactatcattgattttgtcgcactcatcaatggcagttactgctctgtgcctgaagcggctgtgtcactttcgcgcaagcaacatcaggttctgagctgcattgcgaatcaaatgacaacggaagatattctggagaaactgaaaatatcgctaaaaacgttctactgccataaacacaatatcatgatgatcctcaatcttaagcggatcaatgagctggtacgccatcagcatattgattatctggtgtgaatttcaggcttacggtgagtctggctacgctgccacacagattagctaattgaaacgcctttcacccctgccataccttttaataatcgcaacaggtcttctatcgacgttgtggcatgaagctggatatcaatggcgaccacttcatgatcttcattttcctgcaacgaaactaaatcagtttttattttttgctgcttaaaccagtcgagcattgataccgtattaccgttcactaatgtcagctgtaaatggtaatttttgttcatcaggcggaaggttaattgatggaagacttccagcaccaacaaggtcatcactgaaccataaatacccagttcgtacataccgctgccaataaccatacctatggcggcggtcacccagatatccgctgccgtcgtcagacctacaatattttggttacgaacgagaatgttacctgcaccgataaacccgacgcccgtcaccacctgagcagcaatacggctggggtcgagtccgacgtgatctaaagacagcacatcagcaaaaccatatttcgaaacaatcataaacagggcgcttcccatgccaattaatacatgtgtgcgtaaccctgctcctttgccgcgcatttgcctttccatgccaatagcgccacaggcaattgccgcgagtataagacgtataataaattctgctgtcatataaaaatgcaaaaaggagcagcaagatggctcaacttgctactcctttttacttgtacctcattaattcggcaagtcattagatgcttgatttttgaaggtatacaaatttttctgcgggtttttcttacagtattcgatcactttaggaatttgagtgagatcggtttcatttaaagtaacggtatcgccacctttatatactgtttcttcatgcagcatccaccatgcaaccggggtcattgcttttggattcagatcaataaattcctggcaggtcatatctttagcggattcattggctgccagcgcagattgtgcgttcaccagtgacaaagccgctacagcgcccataaaaataaacgctttacggagagatgaaatattcattttgtaacccattcaatatagagattatatatgaacaggaggaatagctgcttttaaagaagatattccggcctgttcaatatgcaaggaagtacgatgtaacgcattcccggaattacatatctttcttaattttgtcccattcgcctttaactttatctttaaagttggcttgtttatcctgagtacaagcctgaacgatagctggggttacggttgcaataccctgaacatctaaaaccgcatcttctggtttatctttgttgttcagcgcttcagcaaaaccaactgcagttggctggaaggattcgtccacagccaggaaatcttcacaggtccaggagttgaccggttttttgttatcagctgctttttgcgcatccgctgcattgctcacaactggcagaagaagcagaccaccaagaataacgcctaatacttttttcatcgtaatatcctcaactataaagtgaaagagccgtcacgaatcaatttcgacactgaggttataacctggttttctgtatatgtcatgttgatggaaaatatcaaaatcagatatttttatttcaatacaatgagttacagatgcatcagatactgcaattaggaaatttttattaaatcgactgcattcttagacgcgtttttggcatagattgatagcaggggattttcttcttaattttatagggtggttctatgttatatatagataaggcaacaattttgaagtttgatctggagatgcttaaaaaacatcgcagagcaatccagtttattgccgtgctgctgtttatcgtcgggttgctgtgtatcagtttcccgttcgtctctggcgatattttaagcacagtagtgggtgcattattaatctgctcgggtattgcgcttattgtcgggttattcagcaaccgcagtcataatttctggccggtattatccggtttcctcgtcgcagtcgcctatttattgatcggctatttcttcatccgcgcaccggagctgggcatttttgccattgcggcatttattgccggtttgttctgtgttgcaggggttattcgcctgatgagttggtatcgtcagcgttcaatgaaaggcagctggctacagctcgttattggtgtgctggatatcgtcattgcctggatattccttggtgcaacgccgatggtgtctgtaacgctggtttccacactggtgggaattgaactgatatttagcgccgccagcctgttcagcttcgccagtttgttcgttaagcagcaataattaccccggttgtcacccggatcatagtcactttatgtgactatgatccgattaatactctctccgctacgcagtgttgtagatcaattgcgcactatcattgaaataataacctgctagtgattatttcaacctactgaatttcatctaatttttttcactccatggcaaattagccatttcaaacattatcatggctgatattttccgtagtcaggtttaatgttttaaaagtgctgtgggaaagtgaacaaagagttccgtaagcgttgatgctatgggcggttaaataagtaatccgggttcatttttttgcaactggcgttgattacattgcataaatatccgtgtctccagacgctatataaaaacctgaagacatgaatgcgttatttactcaggtaatttcaatgcgttaaaagaaagctggcaatccaattgccagcttaagtcgaaacaaggagactcgatatttaaatcggattacattttaactttagtaatattcttcagagatcacaaactggttattgataacttattcttgggcagtaatccgcaaacgttaactttttgtttgctatttacaagctgataacaaccaggaatcttacttaggatcaatatatggagtgcgtgatggataaatctgaagtattgattagtgttaatagacgtattagttcacgaagggtaaagttcttataggcgtttactatattgaacaacgattcggacaaggatgtaaataatgaaaaggatgacatattcgaaacgataacggctaaggagcaagttatgatttttctcatgacgaaagattcttttcttttacagggcttttggcagttgaaagataatcacgaaatgataaaaatcaattccctgtcagagatcaaaaaagtaggcaataaacccttcaaggttatcattgatacctatcacaatcatatccttgatgaagaagcgattaaatttctggagaaattagatgccgagagaattattgttttggcaccttatcacatcagtaaactaaaagctaaagcgcctatttattttgttagccgcaaagaaagtatcaaaaatcttcttgagattacttatggtaaacacttgccccataagaattcacaattatgtttttcacataatcagttcaaaattatgcaactgattctgaaaaataaaaatgaaagcaatatcacgtcgacgctcaatatttcgcaacaaacattaaagattcagaaattcaacattatgtacaagctgaaactaagacgtatgagcgacatcgtcaccctgggtatcacatcttatttttagtcaggacataagcaactgaaattgatggctggcatgacgagggatgcagatgctgatttcattacccccggtgattactaaaggagaggctaaaacgactttattcccctggtatgtgtatccaccagtagaacccttcgttgcccgaatgctggcaggaactgttggcagaacggcaacattttttttgtcgttgacctcaccatgtcgatcactgtgcctgtatcccaccttactggctgacaaccccactatgccgctggtctgtaaatccctcatatctctcctcgcgcgcaatttaaagaaccgttatttctcaagaattttcagggactaaaatgaacagaagaagaaagctgttaataccgttgttattctgcggcgcgatgctcaccgcctgcgatgacaaatcggcggaaaacgccgccgccatgacgcctgaggtcggtgtcgtcacactctcccccggttcggtcaatgtgttgagcgaattgcccggtagaaccgttccttatgaagttgccgagatacgtccccaggtgggcggtattatcattaaacgcaactttatcgaaggcgataaagtgaaccagggcgattcgctgtatcagattgatcctgcacctttacaggccgagctaaactccgccaaaggctcgctggcgaaagcgctctctaccgccagcaatgcccgcatcacctttaaccgccaggcatcgttgctgaagaccaactacgttagccgtcaggattacgacaccgcgcgcacccagttgaatgaagcagaagccaatgtcaccgtcgccaaagcggctgttgaacaggcgacgatcaatctgcaatacgcgaatgtcacctcgccgattacgggcgtcagcgggaaatcgtcggtgaccgtcggcgcactcgttaccgctaatcaggcagattcgctggttaccgtacaacgtctggacccgatttatgtcgatctcacgcagtcggtgcaagatttcttacgcatgaaagaagaggtcgccagtgggcaaatcaaacaggttcagggcagtacgccagtacagctcaatctggaaaatggtaaacgctacagccagaccggcacgctgaaattctccgacccgacagtggatgaaaccacgggctccgtgacgttacgggcgattttccccaacccaaatggtgacttgctgcctggcatgtacgtcacggcattagtggatgaaggtagccgccagaatgtattactggtgccgcaggaaggcgtcacccacaacgcccagggtaaagcaacggcgctcattctggataaagacgatgtcgtgcagctacgcgaaattgaagccagcaaagccatcggcgaccagtgggtcgtcacctctggcttgcaggctggcgatcgggtgatcgtttccggtttgcaacgcattcgtccgggtatcaaagcacgagcaatttcctccagccaggaaaacgccagcaccgaatcgaaacaataacgttgcaggcttaaggggactttcatggctaactattttattgatcgcccggtttttgcctgggtacttgccattattatgatgcttgcaggtggtctggcgatcatgaacttaccggttgcgcagtatccgcagattgcgccaccgaccattaccgtcagcgctacctatccaggtgccgatgcgcaaacggtagaagactcggtcactcaggtgattgagcaaaatatgaatgggcttgatggcctgatgtacatgtcttcaaccagtgatgcggcgggcaatgcctctatcactctgaccttcgagactgggacatctcctgatatcgcacaggttcaagtgcaaaataaactgcaactcgctatgccttcattacctgaagcagtgcagcagcaggggattagcgtcgataagtcgagcagtaatatcctgatggtagcggcgtttatttctgataacggcagcctcaaccagtacgatatcgcggactatgtagcgtctaatatcaaagacccgctaagccgtaccgcgggcgttggtagcgtacaactctttggttccgagtatgccatgcgtatctggctggacccgcaaaaactcaataaatataacctggtaccttccgatgttatttcccagattaaggtgcaaaacaaccagatttccggtggtcaactgggtggcatgccacaggcggcagaccagcagctaaacgcctcgatcattgtgcagacgcgtctgcaaacgccggaagaatttggcaaaatcctgttgaaagttcagcaagatggttcgcaagtgctgctgcgtgatgtcgctcgcgtcgaacttggggcggaagattattccaccgtggcgcgctataacggcaaacctgctgccgggatcgccatcaaactggctgccggagcaaacgccctggatacctcgcgggcagtcaaagaggaactgaaccgcttatcagcctatttcccggcaagtctgaagacggtttatccttacgacaccacgccgtttatcgaaatttctattcaggaagttttcaaaacactggttgaggctatcatcctagtcttcctggtcatgtatctgtttttgcagaatttccgtgccacaatcatcccgacgattgccgtaccggtggttattctcgggacgtttgcgatcttgtcggcggtcggtttcaccatcaacacgttgactatgttcgggatggtgctggcgatagggttactggtggatgacgccatcgtggtggtggagaacgtcgagcgtgtcattgcggaagataagctaccgccgaaggaagcgacgcataaatcgatggggcagatccaacgtgcgctggtcggtattgccgttgttctttccgcagtgtttatgccgatggcctttatgagcggtgcaaccggggagatctaccgccagttctccatcacgctgatctcctccatgctgctttcagtatttgtggcaatgagcctgacccctgccctgtgcgccaccattctgaaagccgcgccggaaggcggtcacaaacctaacgccctgttcgcacgcttcaacacgctgtttgaaaaatcaactcaacactataccgatagcacccgctcgctgttgcgttgtaccggtcgctacatggtggtctacctgctgatttgcgccgggatggcggtgctgttcctgcgcacgccgacctctttcttaccagaagaggatcagggggtatttatgaccaccgcgcagttaccttccggtgccaccatggttaacaccacgaaagtgctgcaacaggtgacggattattatctgactaaagagaaagataatgtccagtcggtgtttaccgttggcggctttggcttcagcggtcaggggcaaaacaacggcctggcgtttatcagtctcaagccgtggtctgaacgtgtcggtgaggaaaactcggttaccgcgatcattcagcgggcaatgattgcgttaagcagtatcaataaagccgtcgtcttcccgttcaacttacccgcggtggctgaactgggtaccgcgtcaggttttgatatggaactgctggacaacggtaacctggggcacgaaaaactaacccaggcgcgaaacgagctgttatcactggcagcgcaatcaccgaatcaggtcaccggggtacgcccgaacggcctggaagatacgccgatgttcaaagtgaacgtcaacgctgcgaaagctgaagcgatgggcgtggcgctgtctgatatcaaccagacaatttccaccgccttcggcagcagctacgtgaacgacttcctcaaccaggggcgggtgaaaaaagtgtatgtccaggcaggcacgccgttccgtatgttgccggataacatcaaccaatggtatgtacgcaacgcctctggcacgatggcaccgctttctgcctactcgtctaccgaatggacctatggttcaccgcgactggaacgctacaacggcatcccgtcaatggagattttaggtgaagcggcggccgggaaaagtaccggtgacgccatgaaatttatggcagacctggtcgctaaacttccggcaggcgtcggctactcatggaccggactatcgtatcaggaagcgttatcctcaaatcaggctcctgcgctgtatgcgatttcactggtcgtggtgttcctcgccctcgccgcactctatgagagctggtcaattccgttctcggtgatgttggttgttccgttaggcgtcgttggcgcattactggccaccgatctgcgcggcttaagtaatgacgtctacttccaggttggtttgctgaccaccatcgggctttccgccaaaaacgccatcctgattgtcgaatttgccgttgagatgatgcagaaagaagggaaaacgccgatagaggcaatcatcgaagcggcgcggatgcgtttacgcccaatcctgatgacctctctggcctttattctcggcgtgctgccgctggttatcagtcatggtgccggttctggcgcgcaaaacgcggtaggtaccggcgtgatgggcgggatgtttgccgcaacagtgctggcaatttacttcgttccggtctttttcgttgtagtggaacatctctttgcccgctttaaaaaagcgtaacgtgtaaatgagagtaaggttgaacgtgaaggttcagccttactctttcctgctaaccattcaccactcaacaaccagctaaccgtcaggaataccaggcttagtacacagcactgaaagtagaaaccactccagccattcgtcatcaatttgaacaacacaatactgacccacattcccgtaatcgtatgaattatcagcttaataatcccaaacatgccgagtcttttcctcctgaaaataccgataccgcctggcaaactgcgaaagagaactagccggtagcccggcagaaatcatcagggaagagtttcacatgaagcaggtgtgagatcctgaccaatattcaaatgcgaaatatgtcaggaaaaggtacctggcgaatgttgcgcaaactgatgtggcgttacaccataatattgtcgaaatgtgtttataaagtacgatgtactgctatagccacatttttccgcaatagtatgcagaggaatttgacgtaactcgagtaatcgtctggccatcgacatcctggaggcgagtaatattttactgaaacaggtattttcatcctgcaacttttttttgattagactctcgctggtatacattctttccgcgatatcgcgcagataccaacgtttggcgatatcaaagctaataaggcgttcaacttttcctgaaacagtgctgatgctattgaaaagtaaggggatcagttctttcttatgagaaaacatcgataaacaggaaaggtagagcatattgctcagtatcggtgaatttaccccggattcattgaagctatcaaaaatcgccgtcaccagcggcatggggggtgactggttaattaacaaacggtctttgctgtgtaaccctaaattgcgtggtagctgacgaatattttgtaagtaatggcaaactgtcagctcatcgatatccagtcgtcgcgtatccggtgaacaaaacgcaaaatcgtctgccaaatttttctccagcagcagaatactctcgttatgcagcgatattttttgctgttcatgataaatatcgaatgaacgacgaatgaggatcaccgagcagacatgagtcatgattatcccttatatttcatactgcgattatttcaatttcagtatactaatgaaatgatgccagactgtttcttagcgcaaaaactgccagatttggtaggaccaaaatttatccacaaagtagttttgcataacagttaattgataataagtaaatgcagcacgaatatattttcgcacagcgtatagcttatgtttataaaaaaatggctgatcttatttccagtaaaagttatatttaacttactgagagcacaaagtttcccgtgccaacagggagtgttataacggtttattagtctggagacggcagactatcctcttcccggtcccctatgccgggttttttttatgtctgagtaaaactctataatcttattccttccgcagaacggtcagtgccgtaaaaattcccttgcgcaacaatacttgccgccgagtcacggttcgacaatctctgcgccgatcgctcctgatactctgtgggcgtcatcccataataatttcgaaagacgtaaatgaaatacgacacgctgtgatatccacaggatactgcaactcgcttaattgaaaaaccatgtataacaataagttgcaaagcacgttgcattctacactcagtaagcaactgtgaatatgatgtctcttcttcgcgcaattttttctttaacagacttggactcatcaacagctcgctggcgattcgggctagtgtccactcatgggcgatattattattgataaccgtacaaactcgtgttcgcatgttcggttgtaaaacgttcagaagcagcggtataaagtgctcatcctcaagaaaaacagataacaacgcaaagattaatgctcttttacgtagcatttctgcatagcgaagattcttattctgcgatagttgcgcaacttcctgaaaaacaggaatatctctactacagtgatgaacgagtaatgaagaaacttttttatgtgcatgaagatttaatgcctcctccttgagcatcgggagaaataatgaaagcgtgtctcttgacacgaatacaaaattttcaacacacttatctactcgaatttggcttgcatccgcaaaaaccaggtcaccgccattaaaatagcgatattcaccattaaccatggtgagaatatatttatgtcttgcatacgcaattagacaattcccatgtagtgattgcatagttgacttaatattacataaacatattactgtttattaatgtagcacgccgccctcttaagtcaaattgattgataaataaatttaaacgaagcgggagaacaggatgataatgtgtgatgttctacgggcaggatgactggatttataatacaaaaacgtgtttaagaacgcagggaaattaatagtaagcaaataatcccttttcgtgacattaaaggtaatcgctacatttaataaacattcatataacatatatcttatcaacacgatgaatagacagccaatatattattgcgattaataagcaaccgaatgcccagctgtttttttaaaggctgggcattcggtttttacaacgttatgttatcaggtgtgtttaaagctgttctgctgggcaataccctgcagtttcgggtgatcgctgagatatttcagggaggctttgtagtcttccagcaacagttcagcaaagtccatttcgaagccgcgacgacacataatgcgcatcaccacgatgtcggtggcttcaccgccgagagtgaaggccggaacctgccagccgcgcagacgcagacgttcagagaggtcgtacagggtgtatcccggatcttcaccatctttcagtttgaagcaaaccgccgggatgccttcgtccgggcgacccgtacagatgaactcatacggccccagtttggcgatttcatccgccagataagcggcaacctggtaagaggcgttctgtactttggtatagccttcacgaccgaggcgcaggaattcatagtactgtgcaattacctgacccgccgggcgggagaagttgatggcaaaagtaccaatttgaccacccaggtagtcaacgttgaacaccagttcctgcggcagcgcttcttcgtcacgccagataacccagccgcagcccagcggagccagaccgaatttatggcctgaagcactgatcgatttcacacgcggcaggcggaagtcccagacgatatccggggcgacgaacggtgccaggaagccaccgctggcagcgtcgatgtgcatgtcgatgtcgataccggtgtcggcctggaatttatccagcgcatcgtgcagcggttgtgggaactcatagttaccggtgtaggtcacgccgaaagtcggcaccacgccgatggtgttttcgtcacaggcttcaatcatgcgtttcgggtccataaacaactgaccggggcgcatagggatctcacgcagctccacatcccagtagcgggcgaatttatgccagcagatttgtaccggaccgcacaccaggtttggtttatccgttggtttgcctgcagcttccatacgcttgcgccaacgccatttcatcgccatcccgccgagcatacaggcctcggaagaaccaatggtgttggtgccaacggcctgaccatttttcggcgcaggcgcatgccacagatcggcaaccatatttacgcaacgcaggtcgatggctgcggattgcggatattcttctttgtcgatccagtttttattgatcgacaaatccatcaatttatggacgttttcgtcgtcccaggtctggcagaaagtggccaggttctgacgagcgttgccatcaagatataattcatcattgataatctggaatgcgacatcatcgcgcatttcgtgcagcggaaatcgttttgactccgcgatagtagaaatggcctttgcgccaaaacgtgaatcgagtagttctgagcggaaatccgttaacagcttctggtccatttcgaactccttaaatttatttgaaggcaataaaaaagtaggatttatccgcaatggaagcaaggcattacaggcttaatttaaataacaaaatcctaagcagaaaaacgactttttataatataaacatttaacatgataatattaaaaacagactttattatcgtaataaaaatcgcccaaacattcctgttcgggcgatcaaattaattattgtttatcctgcatatacggcgtgtacaccccgttcagactgtgcaggaaagctacgatatcatccacatcctcctgcggcagctctttgcctacctgatagcgcagcatcagtttcaccgccccgtccagcgtcggcacgtcaccgcgatggaagtacggtgccgttaaagcaacgttacgtaaaccgggtactttctgacgcaatttatcacgctcttctttagtcacattcatacgaccaatatccgccgccgtaatttccccaaagttaaagtcttttttcagccccaacggttcaaaggaacgtccaccgagaataataccaccatgacaagttgcacatttattatctttaaataattgatagccttttttctgttgcgccgtcagcgcattttcatctccacgcaaccatttatcaaatggggaatccggcgtaattaatgttttctcaaattcagcaatggcatcagtaatattttcgccactgaaaccttgcggatagacgccgaggaactgcgctttaagctgcggatctttttccagcttagcaataatttcgtcccaggatttcgacgccatttcaatcgggttcaacggcggtccaccagcctgatcctgcaatgttgccgcacgaccatcccagaactgctcaacgttaaatactgagttaaataccgtcggcgcgttaatcggcccaactgcgccaccaacaccaatcgatgtttttctgccatcgacgccccccgcattcaacgcatggcaatgagcgcatgaaatggtgctatcagccgataaacggggatcgtgatacagcgcaaagcccaacgccactttttgcgcatcggtaggcagtttttgcgggatgggctgcaccggttcattgcgatgctccggagcagtatcattgctggcgtaatattccgcgcgctgttttgcaatccaggccagtatttccgcccgctcttcatcactcaccttacccgcccagtgtagcgcggtataacgcgttggtggcatagtttcatactgcatcacccattcaatcttattcagatcgctttgcgaaacgggtttatcagccagcagtgccgcacgcacggcctcgaggttaaaagatttatatccaagcttaatgtcgtaatccatcaactgtttcgcgccaggaatataataataggcgggtaattctgccgaaggcgtgtggcaatagtcgcatcctttttcgcggagaaagcctaaaaccttattattttcactgacagcagatgcctgaacatcggcctgtttactgcgtttattatcgtggtaccacacataaccagataaccctaaatagcaaatcgcgacgccagccaggccgatcgcggtaatacgtgagaccattttcattattcttcccccacggtggtgagttattgtgacccagaaaattttccagaatgctgcaaacgtctctgcgagacaaagccatcataaaaaacagtgagatacgctttttgataggaatcaatcaattacatgaatataaactatcaataagatagcctgtgcctattacccagatcaggaatggcatatcatgattgcggcgagagcaggattgaatgttctgaaaatgaaaaacaacacgaaatccgtatttttataaattccatggatattagtgcgttatattttttgacaggttaataaacgtgatccaccgcacgctttgtcgcccaccaggcggagcgaatgactacccttaaagaaaagcccgataattagcgacgaatttcggaggttggatccttatgctcaatcagaaaattcaaaaccctaatccagacgaactgatgatcgaagtcgatctctgctatgagctggacccgtatgaattaaaactggatgagatgatcgaggcagaaccggaacccgagatgattgaagggctgcccgcctctgatgcgctgacgcctgccgatcgctatctcgaactgttcgagcatgttcagtcggcgaaaattttccccgacagtaaaacctttcccgactgcgcacccaaaatggacccgctggatattttaatccgctaccgtaaagtgcgccgtcatcgtgattttgacttgcgcaagtttgttgaaaatcacttctggctgccggaggtctactccagcgagtatgtatcggacccgcaaaattccctgaaagagcatatcgaccagctgtggccggtgctaacccgcgaaccacaggatcacattccgtggtcttctctactggcgctgccgcagtcatatattgtcccgggcggccgttttagcgaaacctactattgggactcctatttcaccatgctggggctggcggaaagtggtcgggaagatttgctgaaatgcatggccgataacttcgcctggatgatcgaaaactatggtcacatccccaacggcaaccgcacctattatttgagccgatcgcaaccaccggtttttgcgctgatggtggagttgtttgaagaagatggtgtacgcggtgcgcgccgctatctcgaccaccttaaaatggaatatgccttctggatggacggtgcagaatcgttgatccctaatcaggcctatcgccatgttgtgcggatgccggacggatcgctgctcaaccgttattgggacgatcgcgacacgccgcgtgacgaatcctggcttgaggacgttgaaaccgcgaaacattctggtcgcccgcccaacgaggtgtaccgcgatttacgcgcgggagcggcctcaggttgggattactcttcccgttggctgcgtgatactggtcgtctggcgagcattcgtaccacccagttcatccccatcgatctgaatgccttcctgtttaaactggagagcgccatcgccaacatctcggcgctgaaaggcgagaaagagacagaagcgctgttccgccagaaggccagtgcccgtcgcgatgcggtaaaccgttacctctgggatgatgaaaacggcatctaccgcgattacgactggcgacgcgaacaactggcgctgttttccgctgccgccattgtgccgctctatgtcggcatggcgaaccatgaacaggccgatcgtctggcaaacgccgtacgcagccggttactgacacctggcgggattctggcaagcgagtacgaaaccggtgaacagtgggataaacccaatggctgggcaccgttacaatggatggcaattcagggatttaaaatgtatggcgatgaccttctgggtgatgaaatcgcgcgcagctggctgaaaacggtgaatcagttctatctggaacagcacaaaatgatcgagaaataccatattgccgatggtgttccccgcgaaggcggcggtggcgagtatccgttgcaggatgggtttggctggactaacggtgtggtacgccgtttaattggtttgtacggcgaaccataatatttttacagccagccgctaacttcctgctggctgtaaaattatcctcttcaggaggagatatttaacatcattgccgcctgggtgcgatttttcacttccagacggcgatacagggattccagatgcgcttttaccgttccggtactgatattcagcgctctgccgatctccttatttgattcgcccgccgctaacatggttaaaatctcccgctggcgggcgcttaacgatttgagatctttaatgtccttttccggcgtcgtccgccagtctccaggcagaaacatcatccccatcgccgcactatttaccgccaacgcaaatgtctcgacggttgaatcacgaggcacaatggccagcacattaaaatggataacttcctgtaaccaccgtttattgcaatccgtcgccgtgattaacaccttaacctcaggaaactgcaccacggttttttgcagcaaccagtagcaaaactcaccatcctgatcgccatcgagcataactaaggcttcagggtaactttccagcttttgccataactcgtctgcctgactggccccctgaatactcactcctggaatacgctgctgtaaactgattttcattccatgaataaatattgactgcctatcaaacatgactatttgcataactgaatctccacctgaatacgttaaaaagacttaagtagtggaagggtattacccgcgagaaaaaataagaattcgccatttggcggtggccattctacagagatgacgcgtagaaaatagttaccgatataaatagttacagctaaacgcctgaaattacatgtcgagggcactatttaaaacaattttgaggatttccttatattggtggttagtacgcatgcaattaaaaatgaaactccgcgactacaagccaaaataacaaatggcaatgagacaaaaataagcacaaatagccaatacgtcctctattcactttaaagggaatcactgaaaaatacgctctgtttaaggggattcacctttctcagaaagctattccgcccttttcctgctgagaaatcgccacattcgtcatgacaacattgtgaaacccggcattagatgttagaaaaaacaataaacaatgcgatatgcgcgttactgtttcgctgtgaacaacaatcggtcaaagaaatggataaaattcacgcaatgcagttgttcatcaaagtcgcggagctggaaagtttttcccgcgcggcggatttctttgctttgccaaagggaagtgtttcgcgccagatacaggcactggaacatcaacttggcacccagcttctccagcgcactacgcgacgggtcaaactcacgccagaaggcatgacctattatcaacgggcaaaagatgtgttgagtaatctcagcgaactggacggtctgtttcaacaggatgccaccagtatcagcggtaaattacgcatcgacatcccgtcaggaatcgcgaaaaacctgttactgccgcgtctgtcggaatttctctatcagcatccgggaattgagctggaactgagtagccataaccgtccggtagatattcttcatgatggttttgattgcgtgatacgcactggcgcgttaccggaagatggcgttatcgcccgtcccctcggcaaactgaccatggtcaactgtgccagtccgcactatctgacgcgctttggttatccgcaaagccccgatgatctgacttcacacgcaatagtgcgttatacaccgcatctgggtgtacatccgttaggttttgaggttgccagcgttaatggcgtccagtggtttaagtctggcggcatgttgacggtaaacagtagcgaaaactatctcgccgccggtcttgccggtctggggattattcagatcccgcgcattgccgtgcgcgaagccctgcgtgccgggcggcttattgaagtattacctggctaccgtgccgagccgctctccctttcgctggtttatccgcagcgtcgggagctttcccggcgtgtaaacctgtttatgcagtggctggctggcgtaatgaaagagtacctggactgaccgactatactttttaagaatgaccacgacagaaggacaaaagagcggatgacgcaggaaaacgagatcaaacgtcccatccaggatctggagcacgagccgattaagccgttggataatagcgagaaaggcagcaaagttagccaggcgctggaaaccgtcaccaccactgccgaaaaagtccaacgccaaccggttattgcgcacctgattcgcgcgacagaacgctttaacgatcggctgggtaaccagtttggtgcggctatcacctatttctcatttttgtcgatgataccaattttgatggtgtcgtttgccgcagggggctttgtgctggcctcccatccgatgttgctacaggatatcttcgacaaaattctgcaaaacatcagcgatccgacgctagccgccacgttgaaaaacaccatcaacaccgccgttcagcagcgtacgactgtagggcttgtcggcctagcggtggcactttattccggcatcaactggatgggtaacctgcgtgaagcgattcgtgcccagtcgcgcgatgtctgggaacgctcgccgcaagatcaggagaagttctgggtaaaatatctgcgagattttatttcgctgattggtttgttgattgcgctgattgtgacgctttcgatcacctcggttgccggttcggcgcagcaaatgattattagcgccctgcacctgaacagcattgagtggctgaaaccgacgtggcgattgattggcctggcgatttccatcttcgccaactatctgcttttcttctggatcttctggcggttgccgcgccaccgtccgcgcaaaaaagccctgattcgcggaacatttctggctgctattggttttgaagtgattaaaatcgtgatgacctacaccctgccatcgttgatgaaatccccctctggcgcagcatttggttccgtgctggggctgatggcatttttctacttcttcgcccgtttgacgctgttttgcgcggcgtggattgccaccgccgaatataaagacgacccgcgaatgccggggaaaacgcagccttaaaataggccggatgcggcgtaaacgccttatccggcatacgattttattcggcctggctccccgtaggccggataagatgcgccagcatcgcatccggctataatgcgcacataacctcttgaaactcatccccagagcctcttcagccatctatttgggagcaaacaatttcattccaactcataaccccagcatataaatccagttggtaacttttatttaacctgaaaccagttttatccactatttataaaattatgtgaagcatttcatagaagaaaaatcactggcctaaacattatcccctttttgcctgatttttgaccatttccgcgatttgttacacattgaaatatcacttttgctgtgcgtaatatggctattcgttagccaaaaaataagaaaagattatgcaagcaacagccacaacactcgaccacgagcaagaatacacgccgatcaactcgcgtaataaagtccttgtcgcctctctcattggcacagccattgagttcttcgacttttacatttacgccactgcggccgttattgtgtttccgcatatcttcttcccgcagggcgatcctacggcagcaacgctacagtcgctcgccaccttcgccatcgccttcgtcgcgcgccccattggctctgccgtttttggtcattttggcgatcgcgttgggcgtaaagcgacgctggtcgcctcgttgctaacgatggggatttcgaccgtggtgattggtctgctgccgggctatgccacgattggtattttcgccccgctgctgctggcgctggctcgatttggtcagggtctgggcttaggcggtgaatggggcggcgcggcgctgctggcgactgaaaacgccccaccgcgcaaacgtgcactgtatggctcctttccgcagctgggcgcaccgattggcttcttctttgccaatggcactttcttgctgctttcctggctactgaccgacgagcagtttatgagctggggctggcgtgtgccatttatcttctcggcggtgctggtcattatcggcctgtatgttcgcgtgtcgctgcatgagtcgccggtgtttgagaaagtcgctaaagcgaaaaaacaggtgaagatcccgctgggtacgctgctgaccaaacatgttcgcgtaaccgtactgggtacgttcattatgctggcaacctatacgctgttttacatcatgacggtctactctatgacctttagtaccgccgccgcgccagttgggcttggcctgccgcgtaacgaagtgttgtggatgttgatgatggcagttattggttttggcgtgatggtgccagtcgctggattactggctgatgcctttggtcgccgtaaaagcatggtaatcatcaccacgctgatcatcctgttcgcgctgttcgcctttaacccactgctcggttctggcaacccgattctggtttttgccttcctgctgctggggttaagtctgatgggtctgaccttcgggccaatgggtgcgctgttaccagagctgtttccgacagaagtgcgttacaccggagcatcgttctcttacaacgtagcgtcgattctcggggcttccgttgcgccatatatcgcagcctggttgcagactaactacgggctaggtgcggtggggttatatctggcggcgatggctggcttgacgttaatcgccctgctgctgacccatgagacgcgacatcagtcgttgtaataagagtgaaaagcctgatgcgctacgcttatcaggcctgaatttccatacaatatattgaattcgcaaggatttgtaggccggataaggcgttcacgccgcatccggcatgaacaaagcacactttgccaacaatctaaatctgtttaattgccggatgtcagacatccggcaattatcatcacttcttcatctgcgacaaaatcgtccgacactgattagcctccccttcggaaggtgagatcagtgccagtaacgccgccgccggtgttaccagcgttgccagtgccgcagcaacagcaccacgggcaatcagcggtccggctttcaccccagcctgcggatttttaaacgtcccccgcacatacagcggcgaacgcagtgtgataatccgaattcctttactctccggatcaatagtcaaatccagctgttccgaagcaaaacttgccgtgccggtaacattaatcaacgcgttctcagtatcgaaagcaaaaatctgcgggcgcgccacgccgttggcaatattcagattcgccgccgcgcagttcacccgcacctcatcatcaccaaatatcgcaccgacaatgtagttgccgacattcagcccaacaatctccatcaggttgcggctcaccagcccgtcattcatcaacagtttcaggttgccgttactgttgcctaaaagtgccgccaccgagttaccgctaccgcgtagttccgcgtcaccgttcatttcccccagcgtcttctgcatcagttccacatcgggcatcagttctttcagtttcagtcgacgagcctgaatatctgcccgcccctgcatcggctttttatcgccttccagatgaatattcgccgcaatgctgccgcccgccatgccaaatttcagcggttgcaggcgcaggtcagcatttttgaggatgatatgagtagaaagatcgctaatcggcaggctactgccatgctcaatgcgccgccctttgaagcgaacatcggcatccataacgtcccatttatcggtttcgaagcggtcataaggcagcactttgcccgcaggctgaacgcttttttcgcccttcttctgttcagaccgtttcgacttttctgcccctttcccggaatcaacgccaatcaacggtcccaggtccgccagccgcaattgccgcgactcgacatcaccttccagttttggtcgtggctttccggtggtgtagaccagagaaccgtggatatcgctatcaccaattcgcccattaaaaccgcgataatcaaagaccgacgatttttcagtgtcgattttcgctaccagccgaccatccgtttcaaacggcggggtatcgggcagcagaacgcccgtcagttcatagagatcacccagtgaatcgccagaaaatttaagccgtaaatcgacaccgcccatcttcattgggtcattcacgacgccatcaaaagcaacacgggtgttaccagagcggaaatcagcctgtaccggaaacggcgtcccttcgccacgcagcgccagcataccgcctatttttcccgtacccgtgagcggttcaccgttatatcgtccctgcgccttcaggccaaaaacgtaatcgcccaccttttctttatccgctttacctttcgatccagtaacttcgctgaacggcagcggcttgcctaagggatcaacaaaaatctccagatccgctttgcttactttgtcatcaatggcgatccgcccttgatcgaaaagaatattatccagccgaaacgaccatgccgacggctttgcattcgcgtctttgttatcatcgttggcaagattaaacgtccagttattgttcttttcagagaggcgaatcaggcgcgcgtcgggcttttcgagcttgatccacggcagccagaccgttttggtcagcagcgccagcggggccagcgttgcctctacgcgtggcaaatgcaccatcgtgacttcgggaatatccggtggattgccaagaatgatgtcttccgcgtgtacatggggccacggcacccagctgcgccagccagtttcttgtttttgccgctcccacaccacgcccagatcgccacggatagcgaacggacgattcaactccgcagagactttctggttgatagtcggtttgagtcgattccagtcaaaagttgcaatcaaaatgatcgccacgacaatcaacaacaagaaagcccctgaaatcgcagcggttattttgcctgccttgctcatcgttcgcttcctcatattcttcctgtgccagtcctaaagatagtccagccaggcggaaaatgaggcagcttatagcgccagaaccgccgtattcagcgtttctatcggtgccgggcgtgaaagaaaccagccttgtgcggcgaatgcgggcgagttctgaacatcacgccactcttccggcgtttctacgccctcgacaatcaccccgcgacaatagcgattcattagatgtaaaagctgagaaaagagtgtgcgtccttccggcgactgacgcagcatcacaaacagttctcgcgcgattttgatgtagtcataacgcacttcacttagcgcagagaaatttgccatcccggtaccaaaatcatccagccacagcgggccaaattcacacatcgaggcaaaggttgaatctttcggcagacggatatgctccaccagttcgaaacgcagccagggaagacgctcaatctggcgcaggatttttggttgctgacgcagggcgatgagcgtagggccatcaatattgaccgatgccagcaggccgtgctctataaagaagtcggctttttgcgccagcaaatcaatctgctctttcacaacctccatccgatggctgacggtgatttcagtaaaatagcgatccggcggcaggcgttgcgaagggttcaagggatgcgtgaccaccgttaatagctccacggccattaaccgcccgcatgtttgatagatcggctgccaggtgtaagcacgctcacactgcaaccaaaaacgccgttcctgcaagctctcgatgcttgcttcagggttgcttattcgctggataacctgccttatcatcaaagatgtcctgtgtttaaaagtgatgctgcccggactcgacaaagattatcggcgcgtaagggcagaactttaccgcctggccggggtaaatttcctcactccacaacggaatctttcaggaatacgttctggctcaaaaaaataatggaacactgttttaatatggttgaccagcaaaccaccacagcgcaaactaacgctaattttttacagatcaggttcacgactatgtccaaaaagattgccgtgattggcgaatgcatgattgagctttccgagaaaggcgcggacgttaagcgcggtttcggcggcgataccctgaacacttccgtctatatcgcccgtcaggtcgatcctgcggcattaaccgttcattacgtaacggcgctgggaacggacagttttagccagcagatgctggacgcctggcacggcgagaacgttgatacttccctgacccaacggatggaaaaccgtctgccgggcctttactacattgaaaccgacagcaccggcgagcgtacgttctactactggcggaacgaagccgccgccaaattctggctggagagtgagcagtctgcggcgatttgcgaagagctggcgaatttcgattatctctacctgagcgggattagcctggcgatcttaagcccgaccagccgcgaaaagctgctttccctgctgcgcgaatgccgcgccaacggcggaaaagtgattttcgacaataactatcgtccgcgcctgtgggccagcaaagaagagacacagcaggtgtaccaacaaatgctggaatgcacggatatcgccttcctgacgctggacgacgaagacgcgctgtggggtcaacagccggtggaagacgtcattgcgcgcacccataacgcgggcgtgaaagaagtggtggtgaaacgcggggcggattcttgcctggtgtccattgctggcgaagggttagtggatgttccggcggtgaaactgccgaaagaaaaagtgatcgataccaccgcagctggcgactctttcagtgccggttatctggcggtacgtctgacaggcggcagcgcggaagacgcggcgaaacgtgggcacctgaccgcaagtaccgttattcagtatcgcggcgcgattatcccgcgtgaggcgatgccagcgtaaacgcagcatatgcaaaaggctggataaagtgttacccctctatccagctcatccataaatacctgatggttgtgctaactcatcaccatcaggcattactgtgcaggtggaatatccgtcacttcaggatgtacgtcatccgtggcgacagaggtggtcgcagcggcggtagatggggccatgatttgatcccagaccgcctgcaacgctttcatgttaaattccggctcgcctttcggctgcagcagtattaacgccatatcattcgacaactgttgacgcagatcctgatttaacatctctaccgtcaggctattaaggaaatcctgccgcagtttctgatattgctccggcgcgatatcgacaacctgattttgcaacgaacgcatccgctgacccatcagaatatcggtatcagctcgtgcataggcggcaaacagtttctgcagctccagtttcttttgcgccactaacgcattgaactcttcttccggcagacctttatcgcgaaccttcgccagttcacgcgccaccagattaaggttgctgttcagcttgtcgtttggtgattcgatgttgatggcacactgcgcacgcagatacagcacacggcagtcaaatccaagaccgatgtctttgctgttactggcacttaacgcttgctgaacatgccagaacagcgcctcgcgggccaggtccgcacgccagtagcgcagcagtgcggctgattcacgaatcggctgccacggcgtatcccacatgatagataaccggtcctgacgcaccgcgtcagtcataatactcaccgcttccgcacgcagcggagaaagcgtcggcaccggagctggcgtttcacgtttgcctttcagttcgccaaacgttttgtttatttggtcgacaaccgagcgcgcatccacgtttcccaccaccagtagcgtcattgcatccggggtgtaccatttctgatagaaatctttaattttttccgcttcaacgggttgtttcagcggatcggcaggatcgtgacctaacaaggttgaccctttcagacgatagcgccaccagccctctttagtatcggcaggccaggttgccaccatgtcctgactttgcagcgcgtggttgatggtttctggtgtgatggtcaatttgccagtggcatttgccagataagagagcgcttctttcagcaaatcgttacggttattgggcaaactcagattaaacagcgtggtgtcataagagacaattaccggcggcatcgggcgtttagggtcgatcccctgctgccacaatgaacgcgcctgtgctgcgtcaaggccaccgctttgcgttagcgcaatacgagggatggcgtgactgtaaccgctctgttgtgtactttcggcgagcgaaccggtattaaccagcaggcgaatttcaacacgatcgctgggacgctggggggtggtcagcacttgccactgtaaaccgttggaaagcgtcccctgttgccatgctggatcaggctggagcgcatctgcctgcacatagccagcagtggccatcatcagcaaaccgcccgctaaaagtcgaatttttgtgccctgcatgtgaacccctgatcaactatcctggtaataaaaaaactgcccgttgtcggtcagtctaaatgacgttaaaaacacttcgtgttagaccgcaagaacatgaaaatgtcacggaagaagtgaaataaacctgaactcacccaggtggtaagttcaggcacaggggtcaattatgcgcaaacacccgcactcggggaagggagtgcgggcataagtgatgagattaagaggataattcgtgcgttttgccatccggcgcacgattattcagcacatcgtccagttttttgtggtccagttctttcacccacttagcaacgacaatggtcgctacgccgttaccgaccaggttagtcagcgcacgagcttctgacataaagcggtcgataccgaggatcagcgccagacccgctaccggcaaatggcccaccgcagagagcgtcgccgccagcacgataaagccactacccgttacccctgccgcccctttagaagaaagcagcaacacgattaacagcgtgatttggtggacgatatccatctgactgttagtggcctgggcgataaacaccgccgccattgtcaggtatatcgatgtgccatcaaggttaaacgagtagcctgtcgggatgaccagccccaccaccgatttacggcagccgagtttctccatcttgtcgagcatacgcggcagcgccgactcggaagatgaagtccccagtacaatcagcagttcttcacggatgtagcggataaatttgaagatactgaaaccagtcgctttagcgattgaacccaataccagcaccacaaacaggatacaggtaatgtagaaacagataatcagctgccccagttgcaccagtgtgccgacgccgtatttaccgatggtaaacgccattgccccgaacgcaccaataggtgccagacgcatgatcatattgatgatgccgaagatgacctgcgagaaactttcgatgacgttaaaaatcagttggcctttgctgcccagacggtggagcgcaaaaccaaacagtacggcaaacagcagcacctgcagaatgttaccgctggcaaatgcgccaatgacgctcgccgggatgacatccataatgaaggcgacaatgccctggtctttcgcctgatcggcgtaaaccgctaccgctttcgcatcaagcgttgccggatcgacgttcattccggcaccaggctgcacgacgttaacgatgataagaccaataatcagcgcgatggtactgacaatttcaaagtaaagcagtgcgactgcgccggtacgaccgaccgccttcatgctttccatgcccgcaatgcccgttacgacggtacaaaagatgacaggagcgatgatcatcttaatgagcttaacgaagccgtcgccaagcggtttcatttgctcgcctatttcaggatagaaatggccaaggagaataccaatggctatcgctgtcaggacctgaaagtaaaggcttttaaacagagaggttttcatagggtgtcctttagtaaaaccacaggtcttgtaaggttatggggtacctgcggccttaaaataacacccagacaacatcacagaaatgtacctggatcataattgaaacaaaaaggttaaaaagtttgagctggctcgcacaaaccagcactttttaaagttttgtaatcagtttggggtagctacttttcttccaggtaactctcttcgaagatttcaatagggagtgggcgagcaaaaaggaagccctgggcaataccaacgcccgcttttgccagccagtcgcgttgtgcttcagtctccacgccttcggcaatcatttgtaagttcaggctctgcgccagcatgataattgcagcaatcatgctgctatctcccggcaagccttcaacaaacattttgtcgattttcagtacgtcgattggcaacgatttcatatgctgcagctgacgcagccctgcgtagcccatgccgaaatcatccagcgccacccgaactccggcattgcgcagcggacggaggattgccaccgcagcatgagggtcgtcaatacgtcggctttctgtcacttccagaatcagtgttcccggctgaatgcgatagcgggttaacagttccagcatatccgccaccatattcgggtgcatcagttgcagcgcagagaggtttaccgacaagggcagcataatgccgcgctcttgccaggctgcaagcaatcgacaggactcttccagcacccagtgaccgacggtaaccatcagcccacagcactcaatgcgatcgattaagccatccggcaggtcccaactgccatccggttgctggatacgcagtaacacttccgcactgaccagtttaccgctggtcatctcgacctgtggctgtaaccaaatagcaaactgatgattttccagtgcattaaggatatcgctctcttccgtcaaccgcttctgggcggcttccatctgctgcggatcaaagaactgaatctgattcttgcctttatggcgagcggtaaatgccgcagaaatagcgcgactgtaaagctgttcggcggtgagatcgccgtagaacatcgccacgccaatgctacagtgcggacggagttgaatacgttcaatcggcaggcgctcgctcatgatagtgagcacttgctgacctaaggtgattgcgtgccacggttcctgtacaccgttggcaatgacagcaaagtcataaccgctaatctgcgcgaggatcatacgtggcgacagtaccgatttgagtttttccaccagcgtcagcagcagaatttctcgttgcgcctctttcagcacgcccgcagtatcacgcagggtttcacaggtgatgatcatcagcgcggtggtttgtttacgcgcgacaacctgctccagcatctccatcagcaaggctttgttcggcaaatccgacaccgggaagcgcatcgcattttcgttctgttcttcataatggcgctgcagcaattgctggttgaggttgtaactgcgcaccaacataccgatttcatcgtcctgatgcagacgcggtaatgccagttggtgaccaacaagctccttggctgggatggcgttaagttcgcgagcaatattgcgtaacggatgcaaaatcaggcggttaatgcaccagctgatggcgacggtcaggataagcgacaaaagtaagtaaatggtcactaacgttgagagggtgctcatcacgaacttatacatacggaaggaatccgcctgtagtaccagataggcaattggctgcgggtttgccggacgttcgagcgagtaaacgcccagcgagatttgaaccggtagctcaaacaggcgagtaaccattaccggcaccgggcgctctggaataaaacttttacgcagcgcctggaactggttaggcagcactacatcggcacggctgaccacgcctgccggtttaatgctggcaagaatagcttccgcttcgggaatatcgcctttcaaaatagctgaagataagggttcgcggacagagcgagcaatgctttccagttgcgtagccgtgttatagcgattctgctggaccagatggaacagcaaaacggtgcaaaaaataaaaacgaacaccaggacaacggctgccaccattgccatctgcttgattgttaacgagcgacttacgcgcaaattgtctccccccggaaatcccagattgccgcccgagtatacccgatcgcagcggcattaagagaggcgctatctgaaaacttaccagtcggcgtaaggtatcagcggctgcggcggtaaatccatgtcaccctgccatccggcggcggaataacgtacgtagagcaggaaatggctgggtgcgtaatctttcgcctgctggatatcaattgccgtgccaacaaaccagttggaagtaacacgtcgttcaagtaatgcccgcgccgtgtagccgaagccctgactgctgccgccatcgttggattgccgcgcagcttcttcctgccagtcggtcgggatcagattcatcagcggataacgcggcatggttttggtgcgtgaatgcgaccacgagccagacgcacccagctcccacgaccagttttccgtgcgctcccgccacatcaccggtatggcaaacgacaggtattcctgcggactgtagtaaccgccctgaccgagtgagtagccactcagatctttgtcgtaatgccagatcatgttgttcaggccgattgtgacgcggcgattgttctggttaatgaccttatagtaatagcccgtcatccagcgcacgcgccagttatcttcgacatttttaccggttaactggtcgccactaagcgatgcccagacgccgtttgcttcacctttatcgtagctcagacttagccccacaccgtcggcacgtacgccaccccattttttcccggtattgctcggggagtctttttgcccaccaaaggccagcaaagaactggagatgggccgacggtgggcgttaacggtgtaacccagcggcccgatatcatcgctgtaactgatgccgccgaccacatccaccacgttgaagcccatcggcgtggtaccgatatcccagctccagacgtcatttcgccagccgaccgccacgttctacaacacgcttccactgcatgacggcaaccattatccgggggtcagcaaaacagcggattacaaagcgcgggcgcagaaattctttgatgaactggacgccttctttactgaacttgagaaatcgggtcgtaaagtgatggtggtcgtggtgccggaacacggcggcgcgctgaagggcgacagaatgcaggtatctggcctacgtgatatccctagcccgtctatcaccgacgtccccgttggggtgaaattcttcggcatgaaggcaccgcatcagggggcaccgattgtcatcgaacaaccgagcagcttcctggctatctccgatctggtggttcgcgttctcgatggcaagattttcaccgaagacaatgttgactggaaaaaactcaccagtgggttgccacaaacagcaccggtctccgagaactcaaatgcagtagttattcaataccaggataaaccgtacgttcgcctgaacggcggcgactgggtgccttacccgcagtaagaacgaaaaaggccgcagagtttcccccctgcggcctggtccgggcgcaaattgccattacggcagcctgacgcccgcatgacacgttacttccgcttgttcagccagttcacgatcatactggcaagaatgccagcaatgaccggagccgctaaatcatgccagaaggccatgcccagctctgcgaacgtcatatagccgcctgtgttgtaatgacaacgtttcgcggctattcttgagtggtctagagtcaagattagcccccgtggtgttgtcaggtgcatacctgcaacgtgcgggggttttctctctccagcaaccaatgccaccagggataaagcccccgcaacattgcgcctcaccggaacctttccggcttgccgctgattctacgactgtttttctgttccggaatccgtcacgtcttcactctgtgctgcgcattccgcagaatattatccgcttgcaaccgttgcatttttcttacgaaaaaggccgcagagtttcacccctgcggcctggtccgggcgcaaattgccattacggcagcctgacgcccgcatgacacgttacttccgcttgttcagccagttcacgatcatactggcaagaatgccagcaatgaccggagccgctaaatcatgccagaaggccatgcccagttctgcgagcgtcatatagccgcctgtgttgtaatgacaacgtttcgcggctattcttgagttgttcaggttcaagaatggcccccgtgatgttgtcaggtgcatacctgcaacgtgcgggggttttctctctccagcaaccaatgccaccagggattaagcccccgcaacattgcgcctcaccggaatccttccggcttgacgctgattctacgactgtttttctgttccggaatccgtctcatcttcactctgtgctgcgcattccgcagaatattatccgcttgcaaccgttgcatttttcttacgaaaaaggccgcagagtttcacccctgcggcctggtccgggcgcaaattgccattacggcagcctgacgcccgcatgacacgttacttccgcttattcagccagttcacgatcatactggcaagaatgccagcaatgaccggagccgctaaatcatgccagaaggccatgcccagttctgcgagcgtcatatagccgcctgtgttgtaatgccaacgtttcgcggctattcttgagttgtttgggttcaagattagcccccgtgatgttgtcaggtgcatacctgcaacgtgcgggggttttctctctccagcaaccaatgccaccagggataaagcccccgcaacattgcgcctcaccggaacctttccggcttgccgctgattctacgattgctttttactgtcagcacccggcaatcttcctcattgcgcgatgccttccagcttaatttctttatttgcaatagttgcagttcatatccgggctgactccagactggtagtgaaatgcgcaattttgtagaattgcgcctcctcgcgacctccccagtgaatctgttgcctcattttttacatactgcgtattcgacttctccacctgttgcgcaagagaaactgggtttattcatttttgcgaggccgacttctttctggacaggactttatgcagcacaacacactatcgaaacacaatcagaaattgccgtttacacgctacgacttcggctgggttttattatgcataggcatggcgattggtgccggaaccgtgctgatgccagtacaaattggcttgaagggaatttgggtatttattaccgcagcgatcattgcttatcctgccacctgggtagtgcaggacatttatttaaaaaccctttctgaaagcgattcctgtaatgactacaccgatattatcagtcattacctggggaagaactggggaattttcctcggggttatctactttttgatgattatccacgggatttttatctactctctctccgtggttttcgacagcgcctcgtacctgaaaaccttcggtttaaccgatgccgatctttcacaatctctactttataaagtcgctattttcgccgtactggtggcgattgcgtctggtggtgaacgattactgtttaagatttccgggccaatggtggtggtcaaagtagggattattgtcgtgttcggttttgcgatgatcccgcactggaatttcgccaatataaccgccttcccgcaagcctccgtctttttccgcgatgtcttgcttaccattccattttgcttcttttctgcagtatttattcaggtacttaacccaatgaatattgcctatcgtaaacgggaagcggataaagtactggcaacccggctcgcgctgcgtacccaccgaattagttatatcacgctcatcgcggtgatcctgttttttgccttttcgtttaccttctcaattagccacgaagaagccgtttctgcctttgaacaaaatatctcagcactggcgctggccgcgcaggtgatccctgggcatatcattcatatcacctctacggtgcttaatatctttgccgtactgaccgcattctttggcatttatctcggtttccacgaggccattaaaggcattattctcaatctgttaagccgaattattgataccaagaaaattaactcacgcgtgctgactctggcgatctgcgcttttatcgtcattacgttgacgatttgggtttcgtttcgtgtatcggtgctggtgttctttcagttgggaagcccgttatatggtattgtgtcgtgcctcattccgtttttcctgatctataaagtcgcacaactggaaaaacttcgcggatttaaagcctggctgattctgctgtacggcattttgctatgcttgtcgccactgttgaagctgattgagtaaaccggagcgcatggccccggttttgtgagttaacgctgcggattttcatcctgatcaacagcaaaacaagctaccagttgaccgccgtagtcttttagctgcggctgcaactgggtgcaggggccgaagcgccgacgacagcgggcgttgaaggcgcaacccggcggtggattcagtgggcttggtagttcaccgctgagcttgatgcgctcgcggcgatcgtccgggttcaggcgcggcgtcgcggaaagtagcgcctgagtgtacggatggcgcgggttattgaagatttggtctttcgttcccttctccacgcagcggcccaggtacatcaccatcacttcatcagcaatgtgctccaccaccgacaggtcgtgggagataaagacataagacagccccaactcctgctgcaaatccatcatcagattcagcacctgcgcgcgcactgaaacatccagcgcggaaaccggttcatcggcaatcaccacatccgggtcgagcatcagaccacgggcgatggcgatacgctgacgctgaccgccggagaacatatgcggatagcggtcatagtgctcggttttcaggccgactttcgccatcatcgacagggctttttcccgacgctgttctttgcttaagctggtgttgatcagcagcggctcttcaagaatttgcccgacttttttacgcggattcagcgaaccgtaagggttctggaagacgatctggattttctgccgacgcagcttctgcgcctgcggatcgtgcttaagcagatcctgcccctggtaatacagctcgccaccggtgggcatttcaatcatcgtcagcaaccgaccgagggtcgatttaccgcagccagattcgcccactactgccagcgttttgccacgttcaaggttaaacgaaacgccatccagcgctttaaccagacgttccggcgcgaacatgcctttcttcaccggataatgttttttcaggtcgatagcctgcaacagcggttgttgcagggtggcctcttgcgtactcatagtgtcggcctcccggcatcatcaagtgggtaatggcatttggactgacgcccgtcagcgagcatattcagcgccggttcttcagcgcgacatctgtcagtggcataggggcagcgcgggttaagcaggcagccgttcgggcggtcgtacttgccgggaacgacacctggcaacgacgccagacgttctttgtcctgagcaaattctggcagcgcacgcagcaatgcctgagtatacgggtgacgcggcgcatggaagatggcgtgcgcatcaccggtttccaccacctggcctgcatacatcacgatgattttatgtgccgcttccgccaccagcgccaggtcatgggtaattaacaccagcgccatgttctctttctgctgtagctccagcagtagttcgatgatttgcgcctgaatggtcacgtccagcgcggtggtcggttcatcggcaatcagcagttttggccgacaggcaatcgccatggcgatcatcacgcgctggctcatgccgccggaaagctgatgcgggtaaacatccagacgcgatgccggatcgggaataccgacctgattcagcaggtcaatcgctcgctgacggcgggtacttttgttgccgccctgatgcaccttaatcgcttccataatctggaaacccacggtgtagcacgggttaaggctggtcatcgggtcctggaagatcatcgccacttcggcacccaccaggttgcggcgctctttttctgagatacgctgcaaatcctggccgttaaactccagtttttctgccattacgcggcccggataatcaatcagccccataatcgccagtgaactgaccgacttaccggagccggactcacccacaatcccgaccacttcgccctgttttacgctgtagctgatgcggtctacggcgcggaacggcgcgctttcgtcgccgaaatgcaccgataatttatctacatttaataacgccatctcgaacctcttactgcttcagtttgggatcgagcgcgtcacgcagaccgtcacccatcaggttaaatgccagcaccgtcagcaggatcgccagacccgggaaggtcacgacccaccaggcgctttgcgcgaactgcaacacgtcggagagcatggtgccccactcaggcgttggcggctgtgcccccatgccgaggaaaccaagagcagccatatcgagaatggcgttagagaaaccgagcgacgcctgaacaatcagcggcgcaaggcagttcgggaagatgttaataaacatctgacgcatcgccccggcacccgccacgcgagacgcggtgacgtaatcgcggttaacttccaccagcacggcggcgcgggttaagcgcacatagtgcggcaaggcaacgaaggtcagtgccagcgcggcgttaccaatcgacgggccgaaaattgccaccagcaccagcgccagcagcagacttggcagcgccagcatgatatcgaccacgcgcataatgatgttatcgaccaggccgccaaagtaaccggcgatcaggccgagaataacgcccataatcagcgataacacaactaccagacagccaaccagcagcgacaggcgcgcaccgtacatcaggcgcgacagcacatcacggcctacgtcatcggtgcccagcaagtgcgccatgctgccgccttcctgccaggctggcggggcgagcagtgcatcgcggaactgttccgccgggttatagggtgcaatccagttggcaaagatcgcgatgaacagcacgatgacgacgtaaaccagcccgacgaccgcgcctttgttgcgtttaaaatagtgccagaactcctgtaacggggtcatcggcaccggtgcgctaatcactttattttcagtaacctgtgacatgatgtccccttacttcttatgacgaatacgcgggttcaccacgccgtacagcagatcgaccagcaagttgacgaggataatcatcgtcgccaccagcaatacgccgccctgcactaccggatagtcgcggcgttgcagtgcgtcaatcaaccagcgtcccagaccgggccacgagaagatggtttcggtcagaatcgcccccgccagcaatgttcccacctgcaggccgataacggtcaccaccggcagcatcgcgttacgcagcgcatggacgataatcacccgcatgcgggttagccctttggcgcgcgcggtgcggatgtaatcctcgcccagcacttccagcatcgaggagcgtgtcatacgcacaatgaccgccagcggaatagtacccagcacaatggcaggcaagatcatatgggcgacggcatcgataaagttgccgtcttcaccccagatggcggtgtcgattagcataaaaccggttaacggattggagtcatcgaggaacaccatatcgctcacgcgaccggagacgggcgtcaggttccagtgcaccgaaaccagcatgatcagcatcatgccccaccagaagataggcattgaataacctgtcagcgccaggccaaccgctgtgtgatcgaaaatggaaccgcgtttaaccgcagccagcacgccgaccggaataccgactgccgtagcaaaaatcatcgcgcagacgccaagttccagcgtggcctggaagcgcggcacgaactcttcccaaaccgggatgcggcttttcattgaaatgcctagatcgccatgcataacgccccaaatgtaatggagatactgctgccacatcggtttatctaagccgagttcagccagcagctgcgcgtgacgctctggggagatcccacgttcgcccgccatgatcatcaccggatcgcccgggatcatgtggacaaaggcaaatgtgagaagggtaataccgataaacgtggggatgacgagtcccaaacgtcggagaataaactgcaacataacccggattctctatagtgacccgcagcctggaactgcgtgtctgtattgctcacaaatcaattcccgcccttatcggacagggaatgaagtattgctgccggatggcgctgcacgcagaggcacagcgccaccgggtatacagattgttgacaaagtgcgctttgtttatgccggatgcggcgttaacgccttatccggcctacaaaatcgtgcaaattcaatacattgcagaattttcgtaggcctgataagcggagcgcatcaggcatttttgcctttgccatcagtcttgtatggcttttaattattcgatagagacgttttcgaagtgatgtttgcctaatggatcaaccacatagcctttaacttctttacgtaccggttcaaacacggtggagtgagcgatgatcagtgccggagcctgatcgtgcatcaccacctgcgcttgtttgtacagttcaacgcgtttattgtggtcgtcggtagcacgcgccggttgaatcagatcttcaaacggtttgtagcaccattttgagtagttggagccttgttcagaggcggcgcagctgaacagggtggcgaagaagttatccggatccccgttatcgccagtccagcccatcattaccgtctggtgctcgccatctttcgcacgcttgaggtactcaccccattcgtaggtgacaattttggcctgcacgccgactttcgcccagtctgcctgaatcatctccgccatgcggcgagcgttcgggttatacggacgttgtaccggcatcgcccacaggtcgatggagaaacctttttccagacccgcttctttcagcaaggctttcgctttttcaggatcgtaggtgtagtcctgaacgtcgtcgttatagccccacatggttggcgggatcaggtttttcgctgatacgcccgcgccctgataaaccgctttgatgatcgcgtctttgttcaccgcgtaggtcagagcctggcgaactttcacgtcatcgagtggttttttctgcacgttatacgagagataaccgacgttcagccccggcatttccatcagattgatggatttatcctgcttcatgcgagcgatatctgccgggttcgggtacggcatcacctggcattcattcttctgcaatttcgcgtaacgcacggaagcgtcaggggtaatagagaaaaccagcgtatcgatctgcggtttggtgccccagtagccatcaaacgctttgtagcggatacgggaatctttttgatactgctgtaactggaacggaccggttccgattgggttgaggtccagtttttccggtgtaccggctttcatcatcgcatcagcatattcttttgacagaatagaggcgaagtccattgccaggtcagcgaggaacggcgcttccgggcgagtcagcacaaactgaacggtgttgtcgtccacctttttcacttcactgatcagctctggcaagcccatgccttcgaagtattcgtagctgccgccagaaactttatggtacgggttttgcgcgtttttctgacgatcgaacgagaacaccacatcatcggcgttcagttcacgcgtcggtttgaattctttattgtcgtgccacttcacacctttacgcagatggaaggtataggttttaccgtcttcgctgacttcccacttttcagcgaggcccgggatcacttcggtggtgccgattttaaattcaaccagacggttataaagcgggacggaagaggcgtcataggtggtgccggaggtaaacagctgcgggttaaacccttccggagatccttctgagcaataaaccagagttttagcctgaacacttgctgcgacggtcatagccaccaggctgagaccaagcttcagcatccctgactttttcaaggaaatacgcattattctgctccaattgtgatgtttgttgttttaaccctttgcagtgggttgtcgctgcctgaccttttttgttttttgcccggtcgggtcaacgttatgaggtggggatgccgtactaattaacatcagtgtaacagtgcggatcctccataaaatgcccctcgtgacctacaatctgtcaacagaatgtgaaaacgtcaatacagccaaccgggatttacaccaacggtgagaatccacaaacaaagattaaaaaaacttcaaacagctatttgcagcagagaaatttgtgctactccaacatgaccagaacaatcagcttaatatttagcaacatttggtgattaagttttatgcatttaatgaaaaaaatctgaggaaaaggtggatatctgagcgattaataccatgaacgctaaaacgcacagcggaaaatgccagggccagccataagtaacgcaaaaaaagatttaagcaaatataaaaaaagacaatggtttctgtcacaaatccgttaatggatagtgagatatggggcgcaaatttggcagggaaatgtgtgtcgtgtaggtcgaataaggcggtcgcgccgcatccgacaatggccggcacatttgcctgatgcgacgctgacgcgtcttatcaggcctacgtcgagtcgaacctccctgcccccggaggttctcatcctcatgagctgcagatgcaaaaaagcctgctcgttgagcaggcttttcgaatttggtcggtgatagaggattcgaacctccgaccccttcgtcccgaacgaagtgcgctaccaggctgcgccaatcaccgaatgcggggcgcatcttactgcgcagatacgccctcgtcaatcccttaatagcaaaatgccttttgatcggcgagaaagtcagcaggccgcttagttagccgctgcctcttttgcctgcgggatgtgacaccagttgttgttttcgttaattccaccatccggtgaagtatagccaagacaacccatgatggtatcgtacagctctacgtgacggcgtggcactttcatgtcggcttcttttttcagctgcgcaaacgcctgcgcattggccggattttccagatatttatctgacatccagaccatcatcggtacgcggaactgctccggcggtgccagttcacgcggcgtgccgtgcaggtgctcgcgttcattaattgactcaccgtggtcagctgcgtagaacacaatcgctttcttatcgcgaacctgatcaatcacgctggagataaagtgatccacataggtcaccgagttgtcataggagttgatcatctgcgctttggtacagccgctatcaacaccaatacattccggcttccactgcgcgaagctacgcggataacgctgggtgtagttaaaatgcgaacctttggtatgcagaatgatcagatgcttaccatccgggttgcgccctagcgattgctgcatttcgtctaccagcaacatatcatctaccggcttgccacgattacgtggctccgcaccaatctgctcacgataagcaatgttgtccgccatcgtgttgctgtagaaccacatttcgctctgcatagcgtagaggtcagaactgaatcctaactgcttcagaaccgcgaaaatgttctgttcttttaatgtgcgctgcggattatcttccgcgcccccctgacgtacaaacatgcaacgcagtgagagtttggttgcggtatcacaggagtaaccacggaacgccgccagatttttctcctgggccagtttcggcgtggtattacgctcatagccgaaaatacccatatggtcccaacgcgtggtttcaccgatgataaacacgacataagtgtcatcaacgttttgcggtgcctgataagtgaatttcttcgccggattaagcaatgaattattatcggaagattcatcgacccgcgcccaggcatacagccccaacgcagaaagccagtttgatggcagataagagttcgctacgacaccgccataactcggcaaatcaacgccggtcgccctctccactttcttctgctggatatccagcaaacgaatcggtgcccaaaccataatacccgccagtacgacgaccgccaggctgcgaatacgctgccctggggttcgcagttgtcggagcaaggtgtagcgacagcggttattccagataaggataagaggcaatgcactaacggcgattaaccagagaataaagttcagaccaacaacttcttttgacaggtcgatatcggtggtcatgacggaagcgatgatgccataaccaatgaccacattaaggaaggtcatgtaatagctggcacctgcggaaaagagcaccaccagcgatgccagaatacgccagctgcggcggccaaacagcgaaagaagacgtagtaaaaagaaggtcaccagtacggtggcggccagttcaacaacagcagaaatgcctttccagacggtaaaatcgtgcgcatagctgccgaagcggcggtaaaaaaccgcgccattcataaaaaggccaatatagattgcaagcaaaaagctcagcttctgctgtgtaatcgatttgatgtatctcatgcaaacaaaccctggacaaacaggtgataacaccctgcttagtggcttttcaggcccggcagggaaaaagtgcggaggtagtcagataagtaaaatctacacgcgcgaataagtagaccacagcaaagggaaaaagtgtggggaaagagtgtgcatgaagcacaaatttacaaaaatgcaagtttgaaaagagactttagcgttacaaaaagcagtaaaaagggccagttaattggcccaaattttacgagtcattgtttatacatttcgttgatgcgtttgatgcacacggaagctgaagcccagtagctcgcggctgagcattaaagggagccatgcgcctcacgcaacattttctgctctggctgacgaatcgtcgtagaaagcgccaatgacagaatcagcagggcgaaaatcacgtagaaggtcacatagaagccgccaaacagtgaggcgataatcgaaccacaaatgctaccgataccgaaaccgagataaatcacaccgtagtttttcgccaggttattgaggccaaagaactcactgaccagtgacggaaagacggtaatagtgccgccaaagttaaatgccacgcaggcaatcgctgcaaagaacgtcactgcattcaatggtgcaaacagcagggccgccatacccaccagcgatatcacctgaccaatggtaataacacggatacgggcgattttgtcagacagaatacccagcaccagacgacctgaaaggttggcgatggaaataacagtgactgcattggctgcggaaaccacatcaaggtgtgccagactttgggcgatatctttcgctaccccaatcacgtacaggccgctcatgcaggcggtcaggaacattaccgctaacatccagtactgcggtttacgcatcgactctgccagcgtgtaatctttctccaccacaccattgctggttttcacttcctgttttggtgcgtctttcattaacgttgcgccgaaaacaatcatcaacagcgcaatcgctccccaaatcacaaaggttttttccagaccgaccgtttccagcagctgcgtgtcgataaatttgaaacccaggctacccagaccataagaaccgatagcgaacgcggagatcagacctttacgctccgggaaccacttcacacagttagagagcgtcagcagataacccgcgccatctgccagtcccaccagcacaccggcgcttaaccacagcatcatcaggttgtcagaatgcgctgtcaggaagaagcctaatcccagcaaaatgccggaagccatggtgacgcgtttaacgccaaaacgttcctgtaatttgcccgcaacagaagacgaaattgccagccccagacttaacaagccgaaagagaaagcgacctggcttaccggcgcatccagcttggcggaaagcgcgccattaaacaggctccaggtataaaccgaccccagcgcaaactgggtaatgatagtaccgatgagtgtcagccagcgggtacgctgataatttgaaggtgtcatggcagtattcctgcagtaataaaaaggaaaaatctctgccgacaaccataacgaagtgcactttatgcctggggaaaaacggcatgaaatgccatcagaacggaatgaaatgccttagttcaggaatgaatgacgcgacaattattcaccaaatttattatttggtaagttagcacccactatcgccacaactattgttatttaatggtttcaattgtgactgttacgttaaaatctggcgctaacccccatcgtatacagatagtcgctattattagtggtattttctgcctgagttagcgcggcataggcggcaatattttgattgagcaacatatcagcgcctacggtgacatccagccagttgccgttctggtttgtcgccgtcatccggctcaggcctgattgcgccttccagatattctcgccaaattgctggttatagctgatttgcgcccagggtcggagatcgccaagccgggagtcaacacgccagcctaaggtactcacgctggcatgccataacggatcggtcagcgtggtagtactgtcgccaaactcgttatacatcgaggtggttgtgccatcgtaatgtaatgccgcgaccgggccggttgtaacctgttcatataaaggaaaattccagcccatactcatactgctggtcacatccacaggggtttcttccgccagattgacttccagtcccagcgccctttggctactttgaatacgttgcgacaaaatatcgttgtaatcaggttgatgatcactatcccaggtgtaacgctctgtggaaagtccgggttgcgtatcaacgatatattcttgttgccaggcgtaagctgtgttgagaaaaaaggcactgattaccacgctcgccagcaggcttagctgccagcgaccaccgcttttttttatgatcattaacacgactccagggaagagccgaattcggcaatattattgtcattgtatgaaggatatcgggcatagtagccctgtattaaatattgactttttcaccgatgcgtcaagaaaagcggctgaaatttttacgatcgggtacatagcgagggaaagtatggaacgttgcggctgggtgagtcaggacccgctttatattgcctaccatgataatgagtggggcgtgcctgaaactgacagtaaaaaactgttcgaaatgatctgccttgaagggcagcaggctgggttatcgtggatcaccgtcctcaaaaaacgcgaaaactatcgcgcctgctttcatcagttcgatccggtgaaggttgccgcaatgcaggaagaggatgtcgaaagactggtacaggacgccgggattatccgccatcgagggaaaattcaggcaattattggtaatgcgcgggcgtacctgcaaatggaacagaacggcgaaccgtttgccgactttgtctggtcgtttgtaaatcatcagccacaggtgacacaagccacaacgttgagcgaaattcccacatctacgtccgcctccgacgccctatctaaggcactgaaaaaacgtggttttaagtttgtcggcaccacaatctgttactcctttatgcaggcatgtgggctggtgaatgatcatgtggttggctgctgttgctatccgggaaataaaccatgattcgggaagcgcaacgttcagaactccccgcgatcctcgaactgtggctggaaagtacaacctgggggcatccctttataaaagcgaattactggcgtgactgcattccgctggtgcgggatgcctatcttgccaatgcgcaaaactgggtctgggaagaggacggtaagcttctcggttttgtcagcattatggaaggccgatttctggcagcaatgtttgtcgcaccgaaggccgtcagacgcggtattggtaaggcgctgatgcagtatgtgcagcagcgctatccccatctgatgctggaggtttatcaaaaaaatcaaccggcgatagatttttaccgtgcgcagggttttcacattgtcgattgcgcatggcaggatgaaacccaactacccacctggattatgagctggccggtggttcaaacgctgtaagtgtcagttccggaccgttgtatttttccagccatgccagcgccgtattacccgcacagccattccccagccgcgagctggggagatctttggtcagcacgttcactgcgccgtttttacaaataccgtcagcggttaaatccagatccggccatgccccttcgtgaatgcaaatcacgccaggtttaattccctcgctaatgaccgctccggcaaggatctgcccacgggagttccacacccgcaccatatccccttcggttatgccgcgcgcctgagcatcgtcaggatgaatggtgacaggctcacggtttgctaccgcgtacaattcgcgcagagaactgtaattcagctggctgtgcaggcggtgcgccggatgggcagaaagtacctgcaactgttctggttcggcattgccctgccattcgtccggctccagccacattggatgccccgggcaatccggataagcgtaatcggcaatacgctgcgagaagatttcaatcttaccgctggcggtttttaatggatgcgcctgcggatcgcggcaaaaatcagcgaagcgaataaaccgctcgctgtccgggttttccggcatctcaattaactggttggcttgccagaactcagcaaatggcggcaattcaacctgctggcttgccccgcgctgtcgggcaacgttataaaacgtttccagccattgcagctcactttttccttccgtaaaacgtgcataaccgcccttctcccagcgttcacttaactcggcaaaaacatcaaaatcattacgcgcttcatagcgtggcggcaccacttgcttcatgggcaccagatgctgattactgtaatcgccggtcatggtgagatcattacgctcaaacgaggtggtcgcaggcagaacgatatccgcgtgtttcgccgccgccgtccagaaacattcggagatcaccaccagctccggtttttgccaggcacggatcaggcggttggtatcctgatgatgagtaaagttggcaccgcccgcccaccagataaaacgaatatccggaaaatgtcggtccataccgttgtgttgatatgcgccaccagggttttccagtgcttcaacaatgcgggccacagggattttatctaccgcatcgcagccacccggcaagctgccctgcatggaagagagcaccgcagaacgccgcgtggggttaccaccattggcaaaatggtaagaaagaccaaaaccgccgccgggtgtgccgatttgccccaacattgctgccagcgtgacgatcatccagtgtttttgctcaccaaactgttggcgctgcattccccagcctgccatcagcatggtggtattttggtggaaaatagccgccagctcgcggattttcgctgcgccaacaccacaaatctctgctgcccattcggcggttttcgctattccgtcactctcgcccagcaaataagaggcgaagacggcataacctgtggtgcaacgcgccagaaacgcttcgtcgtgccaaccattttccaccagcgtatgggcgatccccagcatcagcgcaacatcggtgcccatgtgcggtgccacccactccattttatcgccaaagaaatcgacggtttccgatcgcattggatcaatgcagatcagctttttcccactgtcacgcagtgcagaaaagtaagaaagcccctgctcatcggatgcattccacgcaattttcagcgtattgagtggattagcactccacagcaccacgacatcgctatgttccagcaccagcggccaactggtctgctgttgataaacttcgctaccacccacgacatacggcatgatcgcctgtgccgcgccggtcgaataatcccccagatgcccggtataaccgcctgccagcgccatatagcgttgtaataatgtcgaggccttatgcagcacgccgtttgaacgccagccgtaggaaccagcaaaaatcgatgccggaccataagcctcacgaatgcgtttatgttgttggtgaataagatccagcgcctcatcccaactcacgcgaacaaattcatcctgcccacgaatgccttgcgggttttccggtgacgcgagaaagcctttgcgcaccattggaaatcgtacccgcgtattgctgtgaacctggtcgcgaaccgcgctctgcaaggagttttccattcctgtggctaacgcgccacgcgagctaaacacggtttcgccgtcggtttcaaccagcatgggcccccagtgggcggcagtcagaacggaatatcgtgaggatgagttggccaaaccgaagactcctgaaaggttagatgtattgagcagttaaatattacttacaaatttccgagtattcccaggaataatcttcatgttcacgcggcataatctcccgccacggaacccgtggcaaagaataaaaaggttattaaggattaacaatgaagaaacgtgtttatcttattgccgccgtagtgagtggcgctctggcggtatctggctgcacaactaacccttacaccggcgaacgcgaagcaggtaaatctgctatcggcgcaggtctgggctctctcgtgggcgcgggtattggtgcgctctcttcttcgaagaaagatcgcggtaaaggcgcgctgattggcgcagcagcaggcgcagctctgggcggcggcgttggttattacatggatgtgcaggaagcgaagctgcgcgacaaaatgcgcggcactggtgttagcgtaacccgcagcggggataacattatcctcaatatgccgaacaatgtgaccttcgacagcagcagcgcgactctgaaaccggcaggcgctaacaccctgaccggcgtggcaatggtgctgaaagagtatccgaaaacggcggttaacgtgattggttataccgacagcacggggggtcacgacctgaacatgcgtctctcccagcagcgtgcggattccgttgccagcgcgttgatcacccagggcgtggacgccagccgcatccgtactcagggccttggcccggctaacccaatcgccagcaacagcaccgcagaaggtaaggcgcaaaaccgccgtgtagaaattaccttaagcccgctgtaatccctttcatgccaggtgatgcagaaatcacctggcattcttcagttttccttcatcatatttcaggctaaggtgatcgccttatcagtgaatggagagaagcatgaagccgtccgttatcctctacaaagccttacctgatgatttactgcaacgcctgcaagagcatttcaccgttcaccaggtggcaaacctcagcccacaaaccgtcgaacaaaatgcagcaatttttgccgaagctgaaggtttactgggttcaaacgagaatgttgatgccgcattgctggaaaaaatgccgaaactgcgtgccacatcaacgatctccgtcggctatgacaattttgatgtcgatgcgcttaccgcccgaaaaattctgctgatgcacacgccaaccgtattaacagaaaccgtcgccgatacgctgatggcgctggtgttgtctaccgctcgtcgggttgtggaggtagcagaacgggtaaaagcaggcggatggaccgcgagcataggcccggactggtacggcactgacgttcaccataaaacactgggcattgtcgggatgggacggatcggcatggcgctggcacaacgtgcgcactttggcttcaacatgcccatcctctataacgcgcgccgccaccataaagaagcagaagaacgcttcaacgcccgctactgcgatttggatactctgttacaagagtcagatttcgtttgcctgatcctgccgttaactgatgagacgcatcatctgtttggcgcagaacaattcgccaaaatgaaatcctccgccattttcattaatgccggacgtggcccggtggttgacgaaaatgcactgatcgcagcattgcagaaaggcgaaattcacgctgccgggctggatgtcttcgaacaagagccactgtccgtagattcgccgttgctctcaatggccaacgtcgtcgcagtaccgcatattggatctgccacccatgagacgcgttatggcatggccgcctgtgccgtggataatttgattgatgcgttacaaggaaaggttgagaagaactgtgtgaatccgcacgtcgcggactaagccgcgactgcgtagagtaaagcccgataatcgctcgggcttttactctttattgggttgcagtaactgctgtagtccaggcctgattaaacgcctgatgctgtgccggtaatggcgcaatcagtttgttatattcacttgcctgctgtgaagtcgggaactggatgccatttgcgacaaagctcacctgagtaccttgctgagcaatgtagtctccaaccatcaccagttgttgcgtgaaagtttgtgccgccggaatcaacggttgcaatgcatcagctggcgtcgttaccactttggtgaatgcctgatcaaagaccggtttcaaatcatcgctctgttttagcgcagagtgcgcagcatcggcctgcaacttcgcattttgcagttgttgcgccagcacacccagcgaaccgttcatttcacgcagcggaccgctttgcgtaacgtaatcctgcggtacgcgaattgcgttaacgctgtctacaaccgggcgcagaccggaatccatcgcctgattcacctgctgagaataaccatacagaatcgcgtaatcagagacaaaaggaccaaactgttttttctgatcggcagtcagggttggtagacgttcaccgctacgcatcactgtattctgcaggaagtcgataaacgctttacgctgatcgccttctttatcaaaacacccactcaggctaactaccattaataacgccgcaagaggcgcaaaccagcgagagcaggactttcctgtcgccattttcttactcctttcacccaaaaaaagcgcacaacgacacacgcgtgtctgacgtgacaaggatagtccaggacaggcttgcaggataccctttctacgtaatcttcctggtaaaatcatggagaaaatgaaacaaggttaatttgttgtttcattgttaaaaaatgatagtgccgttgccttttttgtagccagagatttacgccttcgcagaaggttagattttcgaaatctttacaaaacaggagtggtaagagatatatcggcatttatcagatcgttaggtggctataagtcacgctaaatgacaggctgaatcgaatcatagccagagcatgccctgacttcaccccgctgtgtctgcttttcccgactattcttaatgagcttcgatgcaattcacgatcccgcagtgtgatttgaggagttttcaatggaatataaagatccaatgcatgagctgttgagcagcctggaacagattgtttttaaagatgaaacgcagaaaattaccctgacgcacagaacaacgtcctgtaccgaaattgagcagttacgaaaagggacaggattaaaaatcgatgatttcgcccgggttttgggcgtatcagtcgccatggtaaaggaatgggaatccagacgcgtgaagccttcaagtgccgaactaaaattgatgcgtttgattcaagccaacccggcattaagtaagcagttgatggaatagacttttatccactttattgctgtttacggtcctgatgacaggaccgttttccaaccgattaatcataaatatgaaaaataattgttgcatcacccgccaatgcgtggcttaatgcacatcaacggtttgacgtacagaccattaaagcagtgtagtaaggcaagtcccttcaagagttatcgttgatacccctcgtagtgcacattcctttaacgcttcaaaatctgtaaagcacgccatatcgccgaaaggcacacttaattattaaaggtaatacactatgtccggtaaaatgactggtatcgtaaaatggttcaacgctgacaaaggcttcggcttcatcactcctgacgatggctctaaagatgtgttcgtacacttctctgctatccagaacgatggttacaaatctctggacgaaggtcagaaagtgtccttcaccatcgaaagcggcgctaaaggcccggcagctggtaacgtaaccagcctgtaatctctgcttaaaagcacagaatctaagatccctgccatttggcggggatttttttatttgttttcaggaaataaataatcgatcgcgtaataaaatctattattatttttgtgaagaataaatttgggtgcaatgagaatgcgcaacgccgtaagtaaggcgggaataatttcccgccgaagactcttactctttcaatttgcaggctaaaaacgccgccagctcataactctcctgtttaatatgcaattcacacagtgaatctcttatcatccaggtgaaaaataaaagcgtgaaacaaatcactattaaagaaagtaatctatatttctgcggcattcccagcctcctgtgttgatttccaacgagtatgtactgcacccattttgttggacgatgaaatggaatagcccctaatatgtcaaagccaaaatacccttttgaaaagcgccttgaagtcgtgaatcactacttcacaactgatgatggttacaggatcatctcggcacgttttggtgtcccccgaacccaggtcaggacatgggttgccctctatgaaaaacatggagaaaaaggtttaattcccaaacctaaaggcgttagtgctgatccagagttgcgtattaaggtcgtgaaagctgtgatcgagcagcacatgtcccttaatcaggctgctgctcactttatgcttgctggtagtggttctgtagccaggtggctgaaggtctatgaagagcgcggagaagctggtttacgcgcgctcaagattggcaccaaaagaaacattgcaatatcagttgatccagaaaaagcggcatcagcattggagctgtcaaaagaccgacgcattgaggatcttgaaaggcaagttcgatttcttgaaacgcggcttatgtatctaaaaaagctgaaagccttagctcatcccacgaaaaagtgaaagtactcaacgagctaaggcagttttatcctcttgatgagcttctcagggctgcggagataccgcgcagtacgttttattatcatctaaaggctctcagcaagcctgacaagtatgcggacgttaaaaagcgtattagtgagatttatcacgagaatagaggccgatacggataccgtagggtaacgctgtctcttcatcgagaagggaaacagattaaccataaagctgttcagcgcctgatgggaaccctctcacttaaagcagcgattaaggtcaagcgataccgctcttacagaggagaggtagggcaaaccgcccctaatgttctccaaagagatttcaaggctacgcggccaaacgagaagtgggttaccgatgttactgaatttgcagtcaatgggcgcaagctgtatttgtctccagtaatagatctcttcaacaacgaagttatttcttacagcctttcggaaagaccagtgatgaacatggttgagaatatgctcgatcaggcattcaaaaagcttaatcctcacgagcatcctgttctgcactctgaccagggatggcagtatcgtatgagaagatatcaaaatatccttaaagaacatggtattaaacaaagcatgtccagaaaaggcaattgtctggataatgctgtggtggagtgtttctttggaaccttaaagtcggagtgtttttatcttgatgagttcagtaatataagcgaactgaaggatgctgttacggaatatattgaatactacaacagcagaagaattagcctgaaattaaaaggtctgactccaattgaatatcggaatcagacctatatgcctcgtgtttaactgtccaactttttggggtcagtacaaactttgatttatagtcaggtggggcttttctctgtctgcctttcggtgaatacctgagacaaacagtctcaagcacccgtggctattctagcttaataagtttgtttcttctccttgatataatcctaaaaaaatctcataaaattaatatatgagataatctttattcagcagaagattattaaaggttgctgtattatttagcgataaaaaaagcctgccagatggcaggctatttaataacggcgttattattgcaacagcgaaatatccgcaacgcgcaggaacagttcgcgcagtttctccagcatggtcagacggttgatacgcaattctttgtcatcaaccatgaccatcactttatcgaagaaagcatcaaccggttcacgcagctcagccagttcgaccagcgcatcctggtaacgaccttccgtaaagtacggctccagcttgtcacgtagcaccacaacctgcatcgccagtttaatttcttccggctctttcagggtagaggcattcacgcggtcgctcagcacttcgtcagatttcgccagaatgttagatacacgtttgttcgccgccgccagtgcagcagctgcatccagggtacggaaatgcgataccgctttcatacgggcatcgaaatcagccggacgagtcggacgacgcgccagtaccgcctggatggtgtcaacggtataaccttcgtcctgataccaggcgcggaagcgaccgagcataaagtcgataacatcatcaactacgttggcattagtcagcttatcgccatacagacgcaccgcttcttcggtcagcgtttgcagatcaaggttgaggttcttctcaacgataattcgcagcacgccaagcgcggcacgacgcagcgcaaacgggtctttgtcgcctttcggatgctgaccgataccgaagatacccgccagggtatccatcttgtcagcaatcgccagcgcacaagctactgggttggacggcaggtcatcaccagcaaaacgcggctgatactgctcattcagcgccaccgcgacatcttccgcttcgccatcgtgacgcgcatagtgcatccccataacgccctgggtgtcggtgaactcgaagaccatgttggtcatcaggtcgcacttagacagcagacccgcacgggtagcgtggttaacgtcagcgccaatctgttcagcaatccagccagccagcgcctggatgcggtcagttttgtcgcgcagcgtccccaactgttgctggaacaacacggtttgcaggcgcggcaggttatcttcaagacgttttttacggtcggtgttgaagaagaactcggcatccgccagacgcggacgaacgactttctcgttaccggagataatctgctgcggatctttcgattcgatgttggcaacgaagataaagttcggcagcagtttgccgtcgttcgcatacaccgggaagtatttctggtcacctttcatggtgtaaaccagcgcttcagccggcaccgcgaggaatttctcttcgaattttgcggtcagaacgaccggccactccaccagcgaagccacttcttccagcaggctttcgcttaagtcagcgttaccgccaatcttacgcgctgcttcttcggcatcggctttaatcttcgccttacgttcttcgtaatcggcgatgactttcccacgctcacgcagaatttccggatactgatcggcgttatcgatggtgaattccggctcgcccataaagcggtggccgcgaatcacgcgatcggactgaatgcccagaatggttgccggaatgactttgtcgcccagcagcagggtcacggtgtgcaccggacgcacgaagtgcacgtcgcttgcgccccaacgcatcagtttcgggatcggcagtttcgccagagaagtcgcaaccatattcggcagcagtgcttcggtgctttcgcccttcacatgggcgcgatacagcagccattcgcctttatcggtagtcagacgctcagcctggtcaacggtaataccgcaaccacgcgcccaaccttctgccgctttgctcggtttgccttcagcgtcgaacgcctgggcaatcgccgggccgcgtttttcgatttcacgatccggttgcgcttccgccaggttagctactttcagcgccagacgacgcggagcagcaaaccattgaacggtgccgtgtgcgaggccagcgttatccagctccgcagtaaagttcgcagcaaaggactcagccaggctgcgcagtgcttttggtggcagctcttcagtgccgatttccaccagaaaagttttctcagacatagccgcctcttacttatctttgttgcacatcgggaagccgagggcttcacgggaagcgtagtatgcttctgccactgctttggtcagggtgcgaatgcgcagaatgtagcgctgacgctcggtgacggagatggctttacgcgcatccagcaggttgaagctgtgggcggctttcagaatacgctcgtaggctggcagcggcagcggattttccagcgccagcagctgctgcgcttctttctcgtactgctcgaagcaggtgaacaggaagtccacatccgcgtattcgaagttgtaagtggactgctccacttcgttctgatggaacacgtcgccgtaggtggttttacccagcgggccgtcgctccagaccaggtcgtaaacgctgtctacgccctgaatgtacatagccagacgttccagaccgtaggtgatctcgccggtaaccggtttacactccagaccaccaacctgctggaagtaagtgaactgcgtcacttccatgccgttcagccacacttcccagcccagtccccaggcacccagcgtcgggttttcccagttatcttccacgaaacggatgtcgtgaatagtcgggtccatgcccagctctttcagagaaccgaggtacagctcctgaatattgtccggcgatggcttaatgaccacctggaactgatagtagtgctgtaaacggttggggttttcgccgtagcgaccatcggtcgggcgacgagaaggctgaacataagcagccgccatcggttctggccccagcgcgcgcagacaggtcattgggtgagaggttcccgcgccgacttccatgtccaatggttgaacaatggtgcagccctggcgagcccagtaatcctgtaaggtcaggatcaagccctggaaggtcctggtatcaaacttttgcatattatttcgtgctggatacgtgtggatttaaaggaagggatcagtatacccgctggatggaagatatacagtacgaaacgggaaaaagcagggcttaacgcatggaaagatgcaaaaaatggccatccgcgtcaaaagaacagacaaactgctctttacggaaggtataaccgcgcatttcatagcttccctggaactgttcgaaggcggtgacgtcgattttttgctcgccggtgttataacgttttgccgcctgatccttgcataacgcttccatattcaatgaccgaatgggatcaactttcaccctttgagctttctgttctggtggtggtgtagaacaacccactagcaccataagcgccattgccggaaagaaagcgttcatcatcattaaattaccgtctggtttgcaggtgagtcttattatttatatcggtatagtggctgatatcttacgaatttccttaagcctctataagctgtagtgataaaactcagattattccagtgtgccaactgaatgatttatcggtcagactttttttaaccagatacagagacacagatgcagcccaaaatttactggattgataacctgcgagggatagcgtgtttaatggtggtgatgattcacaccactacctggtatgtgaccaatgctcatagtgttagccccgtcacctgggatatcgccaatgttctgaattctgcctctcgtgtcagcgtgccgctatttttcatgatatccggctatctcttttttggcgaacgcagcgcccagccgcgccatttcttgcgtatcggcttatgtctgtttttttatagcgcaatcgcgctgctctacattgcactatttacctccatcaatgtggagttagcgctgaaaaacctgctgcaaaagccagtgttttaccacttatggtttttcttcgcgattgcggtgatttatctggtttcaccgctgattcaggtgaagaacgtcggcggaaaaatgttgctggtactaatggtagtgattggtatcatcgctaacccaaacaccgtgccgcagaaaatcgacggttttgaatggctgccaatgaacttatatatcaatggcgatactttttactacattctgtatggcatgttgggccgcgctatagggatgatggacacgcagcataaagcactgtcgtgggtgagcgcagtactgtttgtgacgggggtttttattatctctcgcgggacattatatgaattgcagtggcgcggaaattttgccgatacctggtatctttactgtgggccgatggtttttatctgcgcaatcgcgctattgactctgattaaaaacacgctggatacgcgtaccattcgcggacttggcttaatctcacgccattcgttgggtatatacggattccacgccttgattatccatgcgctgcgcacccggggaattgagcttaaaaattggccaatactggatattatttggatcttttgcgcgacgttggcagcgagtttgttactttctatgctggtacaacgaatcgacagaaacagattagtgagttaagtaaaagcccggtcacattggactgaccgggcttacgtgagttattcgctgtattcttcctgggtaacctgtgtttcttttggtgggtttattccggcatcacgaatatttttctgcaccgctactgcaccaaacaagcttaagaagaaagccagtccataaaaacctttttcgctgagtaataatgtcgcattccacagacctaccatcagtaatgcaacagagataataaagacagtcaggcaggtcatataataaatggaagtggtcggtatgccttcatacttgtcccgaacggtcttttgataagacgccgcagaaaacagtcctaataccagtacggcaaaataatatcctttttcatttaactgcatctctgcattccatagccctaacagataggtaacgataccaccaacgagagctatccatgacacaatactaaaggctggtgaataggttgatattttgttgtccatcacagtattcctttcattcctgaatatgtaagagctttatgttgctcatgccgagcgaaacaaacgcatttgaccaaacaagcagacaaaaaaggcgatgggatagatcaccatttcataagtattgataggtgcgtttaaaacaccgataaacaagagaccgatagtgattaacgcaactaactggcagatatgggtaaaaaaatcatccagttgcccgagtttttctgcgcgaagatatgcatagttgccaaaagttgctgtcattaacacgccaagaaaatagccttttccacttaacaatgggcatgagatccatagcccaaccagataaaccagcgccccgacaacaaataatagttttgccacagtctttgaggttttcataacgatctccatatctaccagcgatacattacgagtaaccaacgaaagacaaaactgaaaaatgccattaacaaatgattttcagaataaattcatactaaatattaattaattactgagatatatagatgtgaattatcccccacccggtcaggcaggggataacgtttacgccattaatggcagaagttgctgatagaggcgacggaacgtttctcgtcgtggctgataagcggcataacgctgcgcatctggtagatgcgactgttctaacggtagttgcggcaacaattcaatgagcgatttctctggattcgccgcgatctgcgccagccttgctgcgcccagtgctggccccacatccccccccgtacggtaatcgagctgctgaccgctgatatccgccagcatctgacgccagtactcactacgcgccccgcccccaatcaacgtaacactttgcggtttaataccgcaggcatgcacgacatccatgccatctgccagcgcataacccacgccttccagcactgctcgcgccagttcattggggccatgttgatgagtcaaaccaaagaaaacccccttcgcctggggattattgtgtggcgtacgctcgccggaaagataaggcagaaaccaaactggctcggcactttcatcagcctgttgagctgcagcgattaaagctgggacattgctcaggccggttaatttcgcggcccaatccagacacgacgctgcactcagcatcacagacattaaatgccaacgttgcggtagcgcatggcaaaagctatgtacggcgctttctggcttgcttaagaacccttcgctgacagcaaaatagacccccgacgtccccagcgataacattgcctgattagcatcaaccattcccacaccaactgcaccagctgcattgtcgccaccgcctgcgacaactggcaccgtcgccataccccacgctttcgcaacttcaggtaacaaagcaccagtaatttcgctgccttcgtataatgcgggcatctggtcacgagataagtcgcaagcctgcagcatgacgtcactccagtcacgctttgcgacatccagccacatggtgccagctgcgtcagacatatcgctggcaaactcccccgtcatacgcagacgcaagtaatctttcggtaataatactttgtcgatttgacggaatatctccggctcatgccgctgaacccatagcaatttaggcgcagtaaatccgggcatcatcaggttgccggtaatcactcgtgattgcggaactctcgcttccagcaaagtgcactcttgcgcacagcgcccgtcgttccacaaaatggcagggcgcaatacccgttgttgagcatccagtaaggttgctccatgcatctggccggcaatacccaatgctttaacgtcctgcagagaatgctgatcgcccagagctttcattgcgcgatcagttgcctgccaccactgttccgggtcttgttccgaccagagtggatgcgggcgcgaaacggtcagcttttccgtttgcgaagcaaccacctcaccctgctcgttgagcaaaataacttttacgcccgaggtgccaagatctatcccgatatacatatcgatcgttccttaaaaaaatgcccggtatcgctaccgataaccgggccaacggactgcacagttagccgttatttgtcgaacagataatgatttaccagattttccagttgctcctggcgaccactctgatgcaccggagacaaattatgttcctgagcatatttggctaaatctgccagtgacatttggcctttcaggatttgctggcccaattcgctattccagccggaataacgctgcgcgatgcgtttatccagctcgccatcttcaatcatgcgcgctgcaattttcagcgccagtgccatcgtatccatcgcgccgatatgaccgtaaaacagatcatatttatcagtactttgacgacgtactttggcatcgaagttcagaccaccggtggtgaaaccgcctgctttgagaatttcatacatcaccagcgcattctcttccacactgttcgggaactggtcggtgtcccagcccagttgcgcatcgccacggttggcgtcgacagaaccgaacaggccaagcgcaatggcggtggctatttcatgatggaaagagtgacctgccagcgtcgcgtggttagcttcaatgttcagtttaatctctttttccagaccaaactgtttcaggaagccatagaccgtcgcggcatcgtaatcatattgatgtttggtcggttcttgcggtttcggttcgataagcaacgtgccctggaaaccgattttatgtttatgctcaaccaccatctgcataaagcggcccagttgttcacgctcctgacgcaagtcggtatttaacagcgtttcgtaaccttcacgaccgccccacaggacatagttttcaccgcccaatttatgggttgcttccatcgctgtaacaacttgcgttgccgcccagctgaagacttcaggatctgggttcgtcgccgcacccgcgccgtagcgagggtttgtaaagcagttggcggttccccacagcagcttcacgccgctctcttcttgcttgcctgccaggacatcaaccatttgcgcaaaattattgatgtactcttttaacgacgcgccctcaggggaaacatccacatcgtggaagcaataaaatggcacatgtaacttgtggaaaaactcaaatgcgacatctgctttacgcttcgccaacgccagtgcctcaccaggctgctgccacggacgattaaacgcccccacaccaaacatatccgccccgttccagcagaaggtgtgccagtagcaggcggcaaaacgcaagtgctcttccatacgcttacccaacaccagttcgtcgggattgtagtgacggaatgctaacgggtttgaggattttgagccttcataacgaacgcgatcgagctggtcaaaataggcttgcatattgaactccataatcaggtaatgccgcgggtgatggatgatgtcgtaatattgggcactccctttcagttgctcaattatgttatttcacactgctattgagataattcacaagtgtgcgctcgctcgcaaaataaaatggaatgatgaaactgggtaattcctcgaagagaaaaatgcaataagtacaattgcgcaacaaaagtaagatctcggtcataaatcaagaaataaaccaaaaatcgtaatcgaaagataaaaatctgtaattgttttcccctgtttagttgctaaaaattggttacgtttatcgcggtgattgttacttattaaaactgtcctctaactacagaaggccctacaccatgaaaataaagaacattctactcaccctttgcacctcactcctgcttaccaacgttgctgcacacgccaaagaagtcaaaataggtatggcgattgatgatctccgtcttgaacgctggcaaaaagatcgagatatctttgtgaaaaaggcagaatctctcggcgcgaaagtatttgtacagtctgcaaatggcaatgaagaaacacaaatgtcgcagattgaaaacatgataaaccggggtgtcgatgttcttgtcattattccgtataacggtcaggtattaagtaacgttgtaaaagaagccaaacaagaaggcattaaagtattagcttacgaccgtatgattaacgatgcggatatcgatttttatatttctttcgataacgaaaaagtcggtgaactgcaggcaaaagccctggtcgatattgttccgcaaggtaattacttcctgatgggcggctcgccggtagataacaacgccaagctgttccgcgccggacaaatgaaagtgttaaaaccttacgttgattccggaaaaattaaagtcgttggtgaccaatgggttgatggctggttaccggaaaacgcattgaaaattatggaaaacgcgctaaccgccaataataacaaaattgatgctgtagttgcctcaaacgatgccaccgcaggtggggcaattcaggcattaagcgcgcaaggtttatcagggaaagtagcaatctccggccaggatgcggatctcgcaggtattaaacgtattgctgccggtacgcaaactatgacggtgtataaacctattacgttgttggcaaatactgccgcagaaattgccgttgaattgggcaatggtcaggagccaaaagcagatacctcactgaataatggcttgaaagatgtcccctcccgcctcctgacaccgatcgatgtgaataaaaacaacatcaaagatacggtaattaaagacggattccacaaagagagcgagctgtaagcgttacgccccggcgcggagcgggggcgtgatttctctccatgccgcgtgaatgaattggcttaggtggagtcgttatgccttatctacttgaaatgaagaacattaccaaaaccttcggcagtgtgaaggcgattgataacgtctgcttgcggttgaatgctggcgaaatcgtctcactttgtggggaaaatgggtctggtaaatcaacgctgatgaaagtgctgtgtggtatttatccccatggctcctacgaaggcgaaattatttttgcgggagaagagattcaggcgagtcacatccgcgataccgaacgcaaaggtatcgccatcattcatcaggaattggccctggtgaaagaattgaccgtgctggaaaatatcttcctgggtaacgaaataacccacaatggcattatggattatgacctgatgacgctacgctgtcagaagctgctcgcacaggtcagtttatccatttcacctgatacccgcgttggcgatttagggcttgggcaacaacaactggttgaaattgccaaggcacttaataaacaggtgcgcttgttaattctcgatgaaccgacagcctcattaactgagcaggaaacgtcggttttactggatattattcgcgatctacaacagcacggtatcgcctgtatttatatttcgcacaaactcaacgaagtcaaagcgatttccgatacgatttgcgttattcgcgacggacagcacattggtacgcgtgatgctgccggaatgagtgaagacgatattatcaccatgatggtcgggcgagagttaaccgcgctttaccctaatgaaccacataccaccggagatgaaatattacgtattgaacatctgacggcatggcatccgatcaatcgtcatattaaacgagttaatgatgtctcgttttccctgaaacgtggcgaaatactgggtattgccggactcgttggtgccggacgtaccgagaccattcagtgcctgtttggcgtgtggcccggacaatgggaaggaaaaatttatattgatggcaaacaggtagatattcgtaactgtcagcaagccatcgcccaggggattgcgatggtacccgaagacagaaagcgcgacggcatcgttccggtaatggcggttggtaaaaatattaccctcgccgcactcaataaatttaccggtggcattagccagcttgatgacgcggcagagcaaaaatgtattctggaatcaatccagcaactcaaagttaaaacgtcgtcccccgaccttgctattggacgtttgagcggcggcaatcagcaaaaagcgatcctcgctcgctgtctgttacttaacccgcgcattctcattcttgatgaacccaccaggggtatcgatattggcgcgaaatacgagatctacaaattaattaaccaactcgtccagcagggtattgccgttattgtcatctcttccgaattacctgaagtgctcggccttagcgatcgtgtactggtgatgcatgaagggaaactaaaagccaacctgataaatcataacctgactcaggagcaggtgatggaagccgcattgaggagcgaacatcatgtcgaaaagcaatccgtctgaagtgaaattggccgtaccgacatccggtggcttctccgggctgaaatcactgaatttgcaggtcttcgtgatgattgcagctatcatcgcaatcatgctgttctttacctggaccaccgatggtgcctacttaagcgcccgtaacgtctccaacctgttacgccagaccgcgattaccggcatcctcgcggtaggaatggtgttcgtcataatttctgctgaaatcgacctttccgtcggctcaatgatggggctattaggtggcgtcgcggcgatttgtgacgtctggttaggctggcctttgccacttaccatcattgtgacgttggttctgggactgcttctcggtgcctggaacggatggtgggtcgcgtaccgcaaagtcccttcatttattgtcaccctcgcgggcatgttggcatttcgcggcatactcattggcatcaccaacggcacgactgtttcccccaccagcgccgcgatgtcacaaattgggcaaagctatctacctgccagcactggcttcatcattggcgcgcttggcttaatggcttttgttggttggcaatggcgcggaagaatgcgccgtcaggctttgggtttgcagtctccggcctctaccgcagtagtcggtcgccaggctttaaccgctatcatcgtattaggcgcaatctggctgttgaatgattaccgaggcgttcccactcctgttctgctgctgacgttgctgttactcggcggaatgtttatggcaacgcggacggcatttggacgacgcatttatgccatcggcggcaatctggaagcagcacgtctctccgggattaacgttgaacgcaccaaacttgccgtgttcgcgattaacggattaatggtagccatcgccggattaatccttagttctcgacttggcgctggttcaccttctgcgggaaatatcgccgaactggacgcaattgcagcatgcgtgattggcggcaccagcctggctggcggtgtgggaagcgttgccggagcagtaatgggggcatttatcatggcttcactggataacggcatgagtatgatggatgtaccgaccttctggcagtatatcgttaaaggtgcgattctgttgctggcagtatggatggactccgcaaccaaacgccgttcttgattttgataaaaattttctcaaagccggttacgtattaccggttttgagtttttgcatgattcagcaggaaaagaaccatgtttactaaacgtcaccgcatcacattactgttcaatgccaataaagcctatgaccggcaggtagtagaaggcgtaggggaatatttacaggcgtcacaatcggaatgggatattttcattgaagaagatttccgcgcccgcattgataaaatcaaggactggttaggagatggcgtcattgccgacttcgacgacaaacagatcgagcaagcgctggctgatgtcgacgtccccattgttggggttggcggctcgtatcaccttgcagaaagttacccacccgttcattacattgccaccgataactatgcgctggttgaaagcgcatttttgcatttaaaagagaaaggcgttaaccgctttgctttttatggtcttccggaatcaagcggcaaacgttgggccactgagcgcgaatatgcatttcgtcagcttgtcgccgaagaaaagtatcgcggagtggtttatcaggggttagaaaccgcgccagagaactggcaacacgcgcaaaatcggctggcagactggctacaaacgctaccaccgcaaaccgggattattgccgttactgacgcccgagcgcggcatattctgcaagtatgtgaacatctacatattcccgtaccggaaaaattatgcgtgattggcatcgataacgaagaactgacccgctatctgtcgcgtgtcgccctttcttcggtcgctcagggcgcgcggcaaatgggctatcaggcggcaaaactgttgcatcgattattagataaagaagaaatgccgctacagcgaattttggtcccaccagttcgcgtcattgaacggcgctcaacagattatcgctcgctgaccgatcccgccgttattcaggccatgcattacattcgtaatcacgcctgtaaagggattaaagtggatcaggtactggatgcggtcgggatctcgcgctccaatcttgagaagcgttttaaagaagaggtgggtgaaaccatccatgccatgattcatgccgagaagctggagaaagcgcgcagtctgctgatttcaaccaccttgtcgatcaatgagatatcgcaaatgtgcggttatccatcgctgcaatatttctactctgtttttaaaaaagcatatgacacgacgccaaaagagtatcgcgatgtaaatagcgaggtcatgttgtagcgatgatgagaattgtcggcgtcacatcaggtaacgctgcgtggttgtcggatgcggcgtgaacgccttatccgacctacccgccaggcatgataaaacgcaccaacaacgcttcaggctcgtagctcaactgcctgagacaaagtaaaaagccttatccgactgacaagtcggataaggctcaaggaaatgcaattacatatgcgccgcgattaaccgttggttatcctggtacattgcgaacaggtagttgttataactcttccctttggtcgagtagcccttcagcttgtgaatcatcgctgtggcagtcacttcctgatccgctttacgcagctgcgcacgcgatttacggaacgaagagtaagccgggtgcgtattcaggttagtgacataggcgctcaccgattctttgacagaactaaactgtgagtaccctttcactttacctggcgcattggtacaacgtcctttcatgcatttcatgccgaacaggttgttgttgttgcgcgccagcttcgacgttccccaaccgctttctgctgcagccatcgtcgccaccatactggtggggataatgtctacgcgttcaagcaaggtattccacgggatttttcgcgtattaccggaccacttcaccttgtagcgtttggcgatgtctttcagacgcgcacgctcagcaggtgaccattggccctgatactgttttgaaatgagccagttacgttccgcagtaatggccgcattttggctggtaatgtaaggcattacggtccggagaaacgcctttttccttggtgttccggaagggtattttcgcaaatcaggaagtgaactactctttgcactattgcgagaatactcttgtttactgcttacctgtttattactagctttagttaagtgggacttttgactcgctgttgttgtgtgcgttttcgctaacacctcactcgaaaacaccagagtgagtaacataagaatcatcgccccatatcgtcgtatgggagtcaaaatcatcaggtctcctggtcggatttaatcattccaacaccttatatttttcacaaatttgagagttgaatctcaaatcatatcaaaaatagctgtcaagagcaccccaaggaatagtccaaatctgaaactatgtcacgtgttaacgattcagattggcgctaaatcgcagaaaatgtgggggttatcgcaaaattcagccgttttttgcgcgagatcgctcacccttgcttctcatcctgtggacttaccgctcagggatgagttttgtttggcttatcgctggcaaactgtctgaaatcgcagcaataaggactcatccgccatgaaactcgccgcctgttttctgacactccttcctggcttcgccgttgccgccagctggacttctccggggtttcccgcctttagcgaacaggggacaggaacatttgtcagccacgcgcagttgcccaaaggtacgcgtccactaacgctaaattttgaccaacagtgctggcagcctgcggatgcgataaaactcaatcagatgctttccctgcaaccttgtagcaacacgccgcctcaatggcgattgttcagggacggcgaatatacgctgcaaatagacacccgctccggtacgccaacattgatgatttccatccagaacgccgccgaaccggtagcaagcctggtccgtgaatgcccgaaatgggatggattaccgctcacagtggatgtcagcgccactttcccggaaggagccgccgtacgggattattacagccagcaaattgcgatagtgaagaacggtcaaataatgttacaacccgctgccaccagcaacggtttactcctgctggaacgggcagaaactgacacatccgcccctttcgactggcataacgccacggtttactttgtgctgacagatcgtttcgaaaacggcgatcccagtaatgaccagagttacggacgtcataaagacggtatggcggaaattggcacttttcacggcggcgatttacgcggcctgaccaacaaactggattacctccagcagttgggcgttaatgctttatggataagcgccccatttgagcaaattcacggctgggtcggcggcggtacaaaaggcgatttcccgcattatgcctaccacggttattacacacaggactggacgaatcttgatgccaatatgggcaacgaagccgatctacggacgctggttgatagcgcacatcagcgcggtattcgtattctctttgatgtcgtgatgaaccacaccggctatgccacgctggcggatatgcaggagtatcagtttggcgcgttatatctttctggtgacgaagtgaaaaaatcgctgggtgaacgctggagcgactggaaacctgccgccgggcaaacctggcatagctttaacgattacattaatttcagcgacaaaacaggctgggataaatggtggggaaaaaactggatcagaacggatatcggcgattacgacaatcctggattcgacgatctcactatgtcgctagcctttttgccggatatcaaaaccgaatcaactaccgcttctggtctgccggtgttctataaaaacaaaatggatacccacgccaaagccattgacggctatacgccgcgcgattacttaacccactggttaagtcagtgggtccgcgactatgggattgatggttttcgggtcgataccgccaaacatgttgagttgcccgcctggcagcaactgaaaaccgaagccagcgccgcgcttcgcgaatggaaaaaagctaaccccgacaaagcattagatgacaaacctttctggatgaccggtgaagcctggggccacggcgtgatgcaaagtgactactatcgccacggcttcgatgcgatgatcaatttcgattatcaggagcaggcggcgaaagcagtcgactgtctggcgcagatggatacgacctggcagcaaatggcggagaaattgcagggtttcaacgtgttgagctacctctcgtcgcatgatacccgcctgttccgtgaagggggcgacaaagcagcagagttattactattagcgccaggcgcggtacaaatcttttatggtgatgaatcctcgcgtccgttcggtcctacaggttctgatccgctgcaaggtacacgttcggatatgaactggcaggatgttagcggtaaatctgccgccagcgtcgcgcactggcagaaaatcagccagttccgcgcccgccatcccgcaattggcgcgggcaaacaaacgacacttttgctgaagcagggctacggctttgttcgtgagcatggcgacgataaagtgctggtcgtctgggcagggcaacagtaacttttccggcttcccgttcgtcagtacctcgggaagccgccaaccaggataaaatgtcagccctaatcagcgttgcaggataaagcaccgctcactcttcaacagaccgatttgcaccccagcaaatgtagcgttattgttaccttccttgctacagagttcgacagatatcccgctatgacattctccctttttggtgacaaatttacccgccactccggcattacgctgttgatggaagatctgaacgacggtttacgcacgcctggcgcgattatgctcggcggcggtaatccggcgcagatcccggaaatgcaggactacttccagacgctactgaccgacatgctggaaagtggcaaagcgactgatgcactgtgtaactacgacggtccacaggggaaaacggagctactcacactgcttgccggaatgctgcgcgagaagttgggttgggatatcgaaccacagaatattgcactaacaaacggcagccagagcgcgtttttctacttatttaacctgtttgccggacgccgtgccgatggtcgggtcaaaaaagtgctgttcccgcttgcaccggaatacattggctatgctgacgccggactggaagaagatctgtttgtctctgcgcgtccgaatattgaactgctgccggaaggccagtttaaataccacgtcgattttgagcatctgcatattggcgaagaaaccgggatgatttgcgtctcccggccgacgaatccaacaggcaatgtgattactgacgaagagttgctgaagcttgacgcgctggcgaatcaacacggcattccgctggtgattgataacgcttatggcgtcccgttcccgggtatcatcttcagtgaagcgcgcccgctatggaatccgaatatcgtgctgtgcatgagtctttccaagctgggtctacctggctcccgctgcggcattatcatcgccaatgaaaaaatcatcaccgccatcaccaatatgaacggcattatcagcctggcacctggcggtattggtccggcgatgatgtgtgaaatgattaagcgtaacgatctgctgcgcctgtctgaaacagtcatcaaaccgttttactaccagcgtgttcaggaaactatcgccatcattcgccgctatttaccggaaaatcgctgcctgattcataaaccggaaggagccattttcctctggctatggtttaaggatttgcccattacgaccgagcagctctatcagcgcctgaaagcacgcggcgtgctgatggtgccggggcacaacttcttcccagggctggataaaccgtggccgcatacgcatcaatgtatgcgcatgaactacgtaccagagccggagaaaattgaggcgggggtgaagattctggcggaagagatagaaagagcctgggctgaaagtcactaaaaattgcctgatgcgctacgcttatcaggcctacatgatttctgcaatatattgaatttggaagaatttgtaggccggatagggcgtttacgccgcatctggcataaacaaagcacgctattccggcgttgagaaacgccggaaaacgtttcaaacaggctgctgccgtagccgatgccgctgcactttctcgacatccatgcactgcaacgcctttgtcgggcaggcttcaacacaggccggtcccgtctcccgatgccagcacagatcgcacttaatcgccctcgcctttttgcgcgaagaaacgacctccatcgcaccaaacgggcaagccagcatacagcttttacagccaatgcaacgtgtttgttcaacgaaaatatgcccttgttcgcggcttatcgcgtcaacagggcagacattcgcgcacggtgcatcttcacactgatgacaggctactgccgtggtccagctgtggtctttaatgacacgaatacgggaaataaactcgtctggtgacaacgcagcgcaatcctgattctcctgatgcgacactgcgcaagccacttcacaggtacggcaaccgatacatttcgtcgcatccgcaataataaaccggttcatgatcactcctttgcactaaaacagcagagtgccagagagcgcgtccctactgctttgatccaacgaaggaaatgttaaagttttggcacttgtccaaagcgttatgtgatcgcgcccaggtcatccctgacagtaaatcccagttcattagaaatagcctgcgcggtttcacgcagtggtttcaggagatttttctctcccacctgtttcagacgtgatgtcgaaagcgaaatcgacacggcgtacggcacccgcccatgaatatcaaacaccggaacagcaatacaggagacgccgagttcgttttcttctctgtccatcgccgctccgctttcacgaatgtgcgccagttcgtcgaacatcgcgggcagctcggtaatggtattgcgggttaacggctggatctcatgctgatggctttcccagtatgacttcacgtagtccgggtgaccaaacgccatgtagatcttgcccattgcggaacagtagagcggcatatgctggccaatataggcacgggttcgcagcatcccggttgtgggttccagcttataaatcaaaatagcgtgatcgtcttcgcggctggagaagttaatggtttcaccagtggcgatgttcagtgcctcaagatgcggagcggcgatatgaatgatattcagcgaagacagcgccttctgcccgacggcaataaatttggtggtcaggcgataactccctgcggcaggcgcggtggtcacatagccgcaggactgtaatccctgcaataagcgatggacggtactcttatttaaaccagccagctccgaaagatgcgccaacggacaaccgtttggatagttgctcaaaatctcaatcagcatcaacccgcgaaacagactctggcttccggctggacgctctttttcctgcgccatctcgttctctttttttcccatcacttctttccccattttgtcgcgtcctgatggtagcgcaaagtgtgccgtagttcacgatctcgacagataatttataaccaattgatttttatgtcttttgaaattcatcaatcagattgctttgttaaaaagtgatcgatatatttgaaatcaagtttcgcatattgaaattttaagccaaaaaagcgatcaaaaaaacaaggaagcctgggatgaaagtgacatttgagcagttaaaagcagcctttaatcgggtcttaatttcacgcggcgttgacagcgaaacggctgacgcctgtgcagagatgttcgcccgcaccaccgaatccggcgtttattctcacggcgttaatcgtttccctcgtttcattcaacaactggaaaacggcgatatcattcctgatgcccaacccaaacgtataaccagcctcggcgcaattgaacagtgggacgcccagcgttcgatcggtaacctgacagcgaaaaagatgatggatcgcgccattgaactggctgccgatcacggtattggtctggtggcactacgtaatgccaaccactggatgcgcggcggcagctacggctggcaggcggcggaaaaaggctatattggcatttgctggaccaactccatcgccgtaatgccgccgtggggcgcaaaagagtgtcgcatcggcactaacccgctgatcgtcgccattccttccacgccgatcaccatggtcgatatgtcgatgtcgatgttctcttacggcatgttagaagttaaccgtctggcaggtcgtcagctcccggtcgatggtggctttgatgatgagggcaatttgaccaaagaacctggcgttatcgagaagaatcgccgcattttgccgatgggctactggaaaggttctggcatgtcgattgtgctggatatgatcgctactctcctttccgacggcgcatccgttgccgaagtcacccaggacaacagcgacgaatacggcatttcacaaatttttattgccattgaagtggacaagcttatcgacggtcccacccgcgatgccaagctgcaacgcatcatggattacgttactagtgccgagcgtgctgacgaaaatcaggccattcgcttacccggccatgaatttactaccctgctggccgaaaaccgccgtaacggtattaccgttgatgacagcgtgtgggccaaaatccaggcgttataaggagataagtcataatttttggacatatcgcgcagcccaatccgtgccgtttgcccgccgccattgaaaaggcgctcgattttctgcgcgctaccgatttcaacgccctggagccgggcgttgtcgaaatcgacggcaaaaatatttatgcgcaaattatcgatttaaccacacgcgaagcggtggaaaaccgtccggaagtgcatcgtcggtatatcgatattcagtttctggcgtggggtgaagagaaaatcggcattgctattgatacgggaaataataaagtcagcgaatcactattagagcagcgcgatattattttttatcatgacagtgaacatgaatcatttatagaaatgataccgggcagctacgcaattttctttccgcaggatgttcaccgaccaggttgtattttgcaaacagcctctgagatacgaaaaattgtggttaaagtcgcattaacggcgctgaattaatcgaataatcgtctacgccagaacgcctgggtaatgttattgctctaactatattaataattcaggttgctgcacatgcaacatgaattatgacagacatagcctcaaggaatagctatgaaaaaaatactcgaagcaatactggcgattaatctcgccgtactttcctgtattgtgtttataaacattattttaagatatggttttcaaacaagtattttatctgtagatgaattgtcgcgttatttatttgtctggttaacatttattggcgcgattgtggcttttatggataacgcccacgttcaggtcacctttctggtggagaaactctcccccgcatggcagcgacgagtcgctctggttacccattccttaatcttatttatttgtggcgcactggcctggggcgcaacgctaaaaacaattcaggactggagcgattattcaccgatcctcggtttacccatcggcctgatgtatgccgcttatctgcccaccagcctcgttatcgcattctttgaactgcgtcatttatatcaactcatcacgcgtagcaattctctaacgtcgccaccgcaaggagcttaatcatggctgtgctgatttttctgggctgtctgttgggtggtattgctatcggtttgcctatttcctgggcactgttgttgtgcggggcggcgttaatgttctggctggacatgtttgatgtccagatcatggcacaaacgctggtgaacggagccgatagcttctccctgctggcgattccgttctttgtgctggcgggtgaaatcatgaatgcgggcggcttgtcaaaacgcattgttgacctgccgatgaaactggtggggcataaaccaggcgggctgggctacgtcggcgtgctggcggctatgattatggcaagcctttctggttctgccgttgcggataccgccgccgttgccgctctactggtgccgatgatgcgcagcgccaactacccggtcaaccgggcggcggggctgattgcctctggcggcattatcgcgccaattattcccccttccattccgtttattatcttcggcgtttccagcggattatccatcagtaagctgtttatggcgggcattgcccctggcatgatgatgggcgcaacgctgatgcttacctggtggtggcaggccagtcgccttaatttaccccgccagcaaaaagcaacgatgcaggaaatctggcactcttttgtctccggtatctgggcgctgtttcttccagtcatcattattggcgggtttcgctccggtctgtttacccctaccgaagccggggccgttgctgctttctatgcgctgtttgtcgccacagttatttaccgtgaaatgaccttcgccacactttggcatgtactcattggcgcggcgaaaaccacctcagtggttatgtttctggtggcctcggcacaagtttccgcctggctaattaccattgctgaactgccgatgatggtttctgatttactgcaaccgttggtcgattcaccgcgtctgctgtttatcgtcattatggtggctatcctgattgtcggcatggtcatggatttaacgccgacggtattaattcttaccccggtattaatgcctttagttaaagaggcaggaatcgatccgatttatttcggtgtcatgtttatcattaactgctcaatcggcttaattacaccgcctatcggtaatgtacttaacgttatttcaggggtggcaaaactcaaattcgatgatgcagtcagaggcgttttcccttacgtcctggttttatattcattattagtcgtatttgtttttattcccgatctcatcatcctccctttgaaatggattaattaaaaggaaaatattatgaaattacgctctgtaacctacgcattattcattgctggcctggctgcattcagcacatcttctctggcggcacaatctttacgtttcggttatgaaacatcacaaaccgactcgcaacatattgcggcgaaaaaattcaatgatttattgcaggagagaaccaaaggcgagctgaaattaaaactgttcccggacagcactctcggtaacgcgcaggcgatgatcagcggcgtacgtggcggcaccatcgatatggaaatgtccggctcgaataactttgccgggttatcaccagtgatgaacttgcttgatgtccctttcctgttccgcgataccgctcacgcgcataaaacgctcgacggcaaagtcggtgatgatctgaaagcctcacttgaaggtaaaggactgaaagtactggcctactgggaaaacggctggcgcgatgtcaccaactcgcgcgcaccggttaaaacccccgccgacctgaaagggctgaaaatccgcaccaacaatagcccaatgaatatcgccgcattcaaagtctttggcgctaacccgatcccgatgccgtttgccgaagtctataccgggctggaaacccgcactatcgacgctcaggaacacccgatcaacgtcgtctggtcagcaaaatttttcgaagtgcagaagttcctttctctgacgcaccacgcctattccccgcttctggtggtgatcaacaaagcgaagtttgatggcttaagtccggagttccagcaggcgctagtttcatctgcacaagaagcgggtaactatcagcgcaaactggttgctgaagatcagcaaaaaatcatcgacggcatgaaagaagcgggcgtggaagtcatcaccgatctcgaccgcaaagcctttagcgacgcactggggaatcaggttcgcgacatgtttgttaaagatgtgccgcagggagctgatctgctgaaagccgtggatgaggtgcaataaaccatgacgcaatactggctggggttagattgtggcggtagctggctgaaagccgggctgtatgaccgcgaaggccgggaggcaggcgtgcagcgcctgccgctgtgcgcattaagcccgcagccaggctgggcagagcgcgatatggcagaactgtggcaatgctgcatggctgtcattcgcgccctgcttactcattctggtgttagcggggaacaaattgtcggtatcggcatctccgcacagggaaagggcttgtttttgctggataaaaacgacaaaccgctcgggaatgctattttgtcctcggaccgccgggcgatggaaatcgttcgtcgctggcaggaagatggcatcccggaaaaactctacccgctgacccgacaaaccttgtggaccgggcatccggtgtcgctgttacgctggctgaaagagcacgaaccagaacgctacgcgcaaattggctgcgtgatgatgacgcacgactacctgcgctggtgtttaactggcgtcaaaggctgtgaagagagcaatatttccgagtccaacctctacaacatgagtcttggggaatatgacccgtgcctcaccgactggctggggatcgctgaaatcaatcacgccctgccgcctgttgtcggatctgccgaaatctgcggggagatcaccgctcagacagccgccctgaccggtctgaaagcgggtacgcccgttgttggcggcctgtttgatgtggtttccaccgcactctgcgccgggatcgaagacgaatttaccctcaatgcggtgatggggacctgggcggtgaccagcggcataacccgcggtttacgtgacggtgaagcgcatccgtatgtctatggtcgctacgttaacgatggtgaatttatcgttcacgaagccagccctacctcttccggcaacctcgaatggtttaccgcacagtggggagaaatctcgtttgatgagatcaatcaggccgttgccagcttgccgaaggctgggggcgatctctttttcctgccgttcctgtacggcagcaacgccggactcgagatgaccagtggtttctacgggatgcaggccattcacacccgcgcgcacctgttgcaggccatctatgaaggggtggtgttcagccatatgacccacctcaaccgaatgcgcgaacgttttactgatgttcacaccctacgcgtcactggcggcccggcgcactccgatgtctggatgcaaatgctggcggacgtcagcggtctgcgtatcgagctgccgcaggtggaagaaaccggctgctttggtgcggcccttgccgcccgcgtcggcaccggggtttatcacaacttcagcgaagcccaacgtgacttgcgacacccggtgcgcaccctgctgccagatatgaccgcccatcagctttaccaaaaaaaatatcaacgttatcagcatctcattgccgcacttcagggctttcacgcccgcattaaggagcacacattatgagccgaccacttctgcaactggccctcgaccactcatcacttgaagccgcgcagcgcgacgtgacgctgttaaaagacagcgtcgatatcgtcgaagcgggcaccattctctgtttaaacgaagggcttggcgcggtgaaagccttgcgcgaacagtgcccggacaaaatcatcgttgctgactggaaggtcgccgacgctggtgaaacgctcgcgcaacaggcgtttggcgcaggcgctaactggatgaccatcatctgcgccgcgccgctcgcgacggtagaaaaaggccacgcaatggcacaacgctgcgggggtgaaattcagatagagctgttcggtaactggacgctggacgacgcccgcgactggcatcgtattggcgtgcggcaggccatttatcatcgcggtcgtgatgcacaggccagcgggcaacagtggggcgaagccgatctggcacgcatgaaggcgctttcagatatcggccttgagctttccattactggcgggattacccctgctgacctgccgctgtttaaagatatccgcgtgaaagcgtttattgccgggcgggcactggcaggcgcggcaaatccggcgcaagtggctggcgatttccatgcgcaaatcgacgctatctggggaggtgcgcgtgcgtaatcatccgttagggatttatgaaaaagcgctggcgaaagatctctcctggccggagcggctggtgctggcaaaaagctgcggttttgattttgtcgaaatgtcggtggatgaaaccgacgaacggctctcacgtcttgactggagcgccgcacaaaggacttcgctggttgccgcgatgatcgaaacaggtgttgggatcccgtcgatgtgcctgtccgcacatcgtcgctttccctttggtagccgtgacgaggcagtgcgcgaacgggcgcgggaaatcatgagtaaagcgattcgcctggcgcgcgatctcggcattcgcaccatccagctggcaggttatgacgtctattacgaagaccacgacgaaggcacccggcaacgttttgctgaagggctggcgtgggcagtcgaacaggcggcggcatcacaagtaatgctggcggtggagattatggataccgcgtttatgaactccatcagcaaatggaaaaaatgggacgagatgctcgcctcaccgtggttcaccgtctacccggacgtcggcaacctcagcgcctggggcaatgatgttcccgccgaactgaaactgggcattgaccgtatcgccgcgatccacctgaaagacacccagccagtcaccgggcaaagtcccggacagttccgcgacgtgccgtttggcgaaggctgcgtcgatttcgttggcatcttcaaaacgctgcataaactgaactatcgcggttctttcctgattgagatgtggaccgaaaaagccaaagagccggtgctggagattattcaggcgcggcgttggattgaagcgcgtatgcaggaggctggatttatatgttagagcaactgaaagccgacgtgctggcggcgaatctggcgcttcccgctcaccatctggtgacgttcacctggggcaatgtcagcgcggtagacgaaacgcggcaatggatggtaatcaaaccttccggcgtcgagtacgacgtgatgaccgccgacgatatggtggtggttgagatagccagcggtaaggtggtggaaggcagcaaaaaaccctcttccgatacaccaacgcatctggcgctctaccgtcgctatgccgaaattggcggtattgtgcatacccactcgcgccacgccaccatctggtcacaggccgggctggatctccccgcctggggcaccacccacgccgattatttttacggtgccatcccctgcacgcgacagatgaccgcagaggagattaacggcgaatatgaatatcagaccggcgaagtgatcattgaaaccttcgaagaacgtggcaggagtccggcacaaatcccggcggtgctggtgcattctcacggcccgttcgcatggggtaaaaacgccgccgatgccgtgcataacgccgtagtactcgaagaatgcgcctatatgggtctattctcgcgccagcttgcgccgcagctccctgcgatgcaaaacgaactgctggataagcactacctgcgtaagcatggggccaatgcctattacgggcagtaatccctcacgccggggcttcatcgccccggcactacgaattgatatgttccttgctgtaacgccgcttccacgctgctggcattaaaccagtatgtttctgaaaaatctgccggaaatagccaacgtcattaaaccgtattgcatggagcaggccgacaacgtcgagtcactgcataacctgttgctgcccgccgatgcgccatttacgacatttgaaggcaagggattgttcagccataagatcctgattcagacgccaggttcccggtatgaacagagcaatccagagcaacaacctttgtggcattacgacggagcaccagccgcaccgacatccaccggtgaattaaaaacgccagctcaccccggtgacaaaggtaaaactctcattacgatcaatcatcgggctgtcggtaatctcttccggcagctcgctgtatcctgcgctcgccatcaatacgacgtgctctcctatcgggtattttgccgtcaggctgacatagggcacccaggcatcctgcgcggaataacttgccagaccgctacgacgggactcactctctgaaatgccatagtaatagtcactgaaattctcgtcataatagagaacgcccagcgcaggtgtcagcgacagacgacctatctgcattttgtggaataccgatagctcccccacccagccgttgctgttatccagaacgtccgcagctgcagaggctttcacggttccccaacgctcgtggtgataccaggcaacccccgccatagccgtactatcacgcttatcaagctgttgcatggcataatcgtcattatcggtagggtcaaattccagcggcatccaggatgcggtcaggctaagttcatttttttcactttgcgacagaataaaacctaacgtggtctgacgaacataaaaagtatcaccttcataactaatcagcggaattgccttcgtattttcattataaccgcgataaggcgattcattataagccgcaccagcaccaatggataattcagaagcagttgcgcttgccataaaaggcaacgcaaataacgccacaatattgcgattaattaacatgtccggtattccattttaaaataagataaaaaagagtcggcataataatgcttacaatttctccggtgcaagattcatatttatatagtaatatataaaattatatataattgggctgttgcgatgacaaaattacaacttaagtaccgggagttaaaaattatctcggtaatcgctgccagtgaaaatatcagccatgccgcgactgtacttggcatcgcacaggccaacgtcagcaaatatcttgctgattttgaatcaaaagtgggtttaaaagtctttgaccgaaccacccggcagctgatgctcacaccttttggcaccgcgctgttaccgtacatcaacgacatgctggacagaaacgagcaacttaataattttattgcagattataagcatgagaaacgtggtcgggtcaccatctacgccccaaccggcataattacctatttatccaaacatgtaatcgataaaattaaagatatcggtgatatcaccttatcgctaaaaacctgcaatcttgagcgtaatgccttttatgaaggcgtcgaatttcctgatgattgtgatgttttaatcagctacgctccaccaaaagatgaatcgctggttgccagttttattacccaatatgccgtaaccgcttatgccagccagcgctatcttgagaaacatcccattagccgtcctgacgaactcgaacatcactcctgtattttgatcgactcgatgatgatcgacgacgcgaatatctggcgcttcaacgtcgccgggagtaaagaggtgcgggattatcgcgtgaagggaaattacgtttgcgacaacacgcaatctgcgctggagctggcacgaaatcacctggggattgtgtttgcgccagacaaaagtgtgcagagcgacctgcaagacggcacgctggtgccctgctttcagcacccgtatgaatggtggctggatctggtggctatcttccgtaaacgggaataccagccctggcgggtccagtatgtgctggatgaaatgctgcgtgaaattcgccaccagcttgctcagtcgcagcaattgcggcctgaacaagcagcggaaagcgaagattaatgatcgagataaaggtaatgcacccaactggtcatgcgtaacagcactttgcgcatcaccgagacatggctgaaatgatcagagtagaccgccacctgggcgtaaataccgtctggtaaagcgctcaaatcagtgtgctcatctagttcaatggtcgcgataacgccatctgaacccggcgctatgtttaacgtctgtaaggtgccggtcgactgataagctccgccgggaacagctggactaatggctgccagcttaccgctgaacactttgcctggcagagcgttaaataccacttccgcatcatcgccgggagccaggcgcagcaaggagttctgacggaactgcgccacgatttgtcgtttctgatcgggtataaacaccatcaccggacgtagcggcagcgacgcggcataggtacccggacgaatcagcacctgggtcacataaccatcgctcggcgcacgcactatcgtctgctcaaggttatattttgcttccgcgagctgcgctttcaggctggcgatttgagaatgttcacccaacaccaggctatccagctggctctggatctgtttttgttccgccgccgatgactttacggaggcttcctgcgccagataattttgccgcgccacatcaatatcgcgttctgaaaacgggtttactttcgcctggctgccgcgtgcgtaacgctgatactctttagcgaatttatcccgcgtggcctttgcctgctgagtattcgccgccatctcatctaactctgcgcccaacgcccgctgtttatgttctgcggtaacgatatccgccatcagccgatccacccgcgcctgataacgcgtcgggtccagtcgaaatagcacctcaccttttttaatcagcgtatttttcttatccgtcacttcgatcaccacgcctgtcacctgtgggacaacaggaatagaaataaccgctttttgcgctttgaaggtatacggatggttatagttcattaacagaattaaaccactgacaataaatatgccacccagagccgctgtgggaatggtccatttatttacaggaattttgaagatcttaaacattgcccatgcaaaagccacataggtcaaaataatcagtaaatccataagtattactcggcagaagaggatttgatgtcggcgagctgtttctccagcccggcaatacgctgttgtagttgcacaacggaggagtcatggttttgcattccccatccccgctccgggcggtaaagcgtggcccaaatccacaaaaatggccagataacatgcagcgtaaaaagactcacccaaccagcaacatgaatggcgtcggcatgaggatgattacgttttttagcaatcaggtagggaatatcatgtaaaataataatcccatagaatatcaccagaaatacaaaaataagcactcccagtgcaaaatagtccaggaacatatttccctcaaagaatataaaaaagaacaattaacgcatattatgaaatgccatgatgcagtgcaatttccttatttatataacgacatattgttttttatatactttctgaaatgtgctgtctggtttttcaacaggacgaggtttatcatattgaaatagtggaactattggccaaactaatgaataactccagtaaaacatccacagtacagattaagcgtattaaaccttcaattatctaccgtttattgctgattggcctcggatcaccaatggtgatttacggcctggttcgcccgctcaccatcgaaacgcgagattaaactcctgacaaaacacgccccagaaacgcacttctgttggcgtagtctgggttattgcgcacgtaggtttaaaacgtaaattgtaacaacgtgcgctttgtttatgccggatgcggcgtgtacgccttatccggcctacggtcaggttcccgtaggcatgataagacgcgtaagcgtcgcatcaggcaatgaatacccaatgcgaccagcttcttatatcagaacagccccaacggtttatccgagtagctcaccagcaggcacttggtttgctggtaatgctccagcatcatcttgtgggtttcgcgaccgatacctgattgtttgtagccaccaaacgcagcatgtgccgggtaagcgtgatagcagttggtccacacgcgcccagcctgtatgccgcgccccatcttataggccagattaccgttgcggctccagacacctgcgcccaggccatattgcgtgtcgttcgccagctccagcgcctcatccatcgttttaaaggtggtcaccgccagcaccgggccaaaaatctcctcctggaacacgcgcatattgttctgaccaaacaaaatcgtcggttcgaggtagtagccgtctttcagttcaccttccagcagcttgcgccgcccgcctgtgagcacgtcagcgccctcttttttaccgatatcaatgtagttgaggatggtttccagttgcccgtgagaaacctgcgcgcccatttgcgtcacgctgtcgagcgggttaccgctacgaatgctttcgacacggcggatggcgcgttccataaagcgttcgtagatagattcctgcactaaagcacgactcggacaggtgcaaacttcgccctggttaaaggcaaacagtgcaaagccttccagcgctttatcgaaaaaggcatcttcttcatccatcacatcagcaaagaagatatttggcgatttgccgcccagctccagcgtcaccggaataatgttttgcgtggcgtattgcataatttgttggcccacttccgttgagccggtaaacgccactttggcgatgcgtttcgaggtcgccagatattcgccaatttccccacctgcgccgttgaccacgttcaccacgcccggcggcagtaaatcaccgacgatttccattagcagcagtacagaaagcggggtaagacgtgcgggtttcagcaccacacagttgcccgccgccagcgcgggagccattttccagctcgccatcagcagcgggaagttccacggaataatctgccccaccacgcctaacggttcgtggaaatgataggccacggtttcgctatcaacttcactgataccgccttcctgtgcccggatacacgaggcgaaatagcggaaatggtcaatcgccagcggtacatcagcagcactggtttcgcgaatgggtttgccgttatcccaggtttcagctgtcgctaacagctcgaggttttgttccattcgatcggcaatcttaaacagaatcgccgcacgatcctgcaccgaggtgtgcgcccatttatctttcactttgtgcgcagcatccagcgccagatcgatgtctcgtttgcccgaagacgccacttcgcacagcagctgcccggtcaccggcgtcagattctggtaatactcgccgtcggcaggggctacccattcgccgccaataaagttgtcatagcgggcttttaacttgagggggaaaccatactcgccgggcttaatctgtgctgaagggggattattggtcatgatcgtctccttgcggtgtgaggtataacaagggtagacgtgactggcgaaatcttcgccagtcggtaacagctttacgacagctatcacgaatttacgggcaagggttacagagatagttgaaaaagcggctgacaatttgccagccgttgtggaaatgatgattacatcgctgcgcgataaatcgccacaatttcttcgtgagttgcctggatcgggttagtaaaaccacaggcatctttcagggcattagttgccagaaccgcgaaatcttcttctttcacgttcaggtcgcgtaggcctgccgggatatccactttcttcgccagttcacggatggcgttaatgcaggcttcagcaccttccgcatcgtttttacctgtcacgttcacgcccattgcagcggcacagtcacgcagacgtgcggcggcgactttgctgttgaatacctgaacatgcggcagcaaaacggcgttacatacaccgtgtggcaggttgtagaaaccgcccagctggtgcgccatcgcatgaacataacccagagaagcattattgaacgccataccggcgaggaactgggcataagccattgcttcacgcgctttcgcattactgccatcttcaacggctaacggcaggttttcggcaatcatggtcacggctttcagtgcacaagcgtcagtgatcggcgtggcggcaatagaaacatacgcttcgatagcgtgcgttaaggcgtccataccagtggcggcggtcagtgacttcggcataccgatcatcagcgaggagtcattgacagaaagcagcggagtcacgtgcttatcaacaatcgccattttgatgtgacgcgcttcgtcggtgatgatgcagaaacgagtcatttctgatgctgtacccgcagtggtattgatggcgatcatcggcagctgcggttttgcagagcggtcaacgccttcataatcacggatatcaccaccattggctgccaccagcgcaataccttttgcacagtcatgcggagaaccaccgcctaaggaaatcacgctatcgcaattattttctttaagtaatttcaaacctgcggcgacgttttccgtggttgggttaggttgggtgccatcataaataacgctaaaaatattgcgttcttccagtgctttttgcacatcacccgccatacctaatttcgttaacatattgtcagtgacaattaaggtacgggtaaatccataatctgccatcatattcattgcatcagtcaatgaatcagcgccgatgacattcacagaaggaataaagaaagttgaagatgccataacacactcctgaaagtgtaaaaaagggcgggcagcttactgaggattttcattcgaaaatatgatcagtattattgattatcaaaattaatctaataaaaagcacattgtattcattaaacaatgtgctttttttaaaatcataagaaatttgtattaatttattttaaaaattaattaatcatttccttatttttccggaaataataatgcgtcgcgcaataaatgatcatttccacgacgacgcgtaaagccaatgcggtcaaaatattccagaatctgaattgccagctttcggcctacgcctaagcgatcgcggaaatccgccgcgcaggttgaaccacactcctgatcgagatcgcggatcatattggcaaattcgacaatccgatcgttacggtaataacgatctttgacgatcgcggtaattattccttgctgcgccgcctggcgcagcgtcaggcgcattgcctgctcgtcggttcccgtctcttttgccaggtcacgcacccaccacggctcgtcaccaaacagcggctctgctttttgccagatggcctgctgctcttcgctgaagcccgctttgtgatctggcagatgcagccaaccgtgatgactgaggatgtcgccgctttcgcgcatcttttcaatcagcaacagtaccagcgcttcatcttccattggcaacgccatacgtcgcagacgttcgcgcccaggaccaggttcatcgcgatgttgctcatgataagtcgctaatgtgtcgagaattttccgctgccagcgggcggcaaccggcgcattcaacaagctataaccagcctgaatataaccaggctgttgcagcaattcgcgcatcccttcgccgttgagctggcgcgcccaggcgaaatccgcaaggttaaccgcgccgcgttccagatgaacagataacgcatcggcatcgctctgcgcccgtgcaagagacgccagccattgcagatattccggcttacgtttaccgcgacgcggcgggttaagcatcacgacgcgcgctccggccagcgtgttgcgggcagagatatcgcgcaataccaggcggtcgttatctgccagccataacggggtgtcgaagaccagttcagcaaggttatcttccagcagtgaaacgcgtcccgtgacgtggctggcggcgtggtgaatatgcagcggctgccactgggtcagcggtgtatgggtttgaagctcgacaatcacccgtgtgaacggctctggcggcacatcggcaagcagccagtcgccacggttaatctgctctttttccgcatcacccgcgatgttaagcgcgatacgctgcccggcattggcggtttctgttggctggttttgcgcatgcagcgcacgtacacgcatcggtttatttacaccagtcagccagagtgaatcgcctaccttcacttccccgcttaacgccgtaccggtgacgaccagcccggcaccttttacggtaaatgcgcggtcaatcgcgaggcggaaactatgttggctggcgtgctcgcgttccggcaactgaagcagatgctcgcgcagggcatccattccccgaccttcggttgctgcggtgataaacagttttgcctcagcaaaaccgtattcccgcagaacctcctttacctggcgttcaacctcatcaacacgcgcttcgtccacgcgatcggctttggtcagcgccactgtcagcatcgggttaccggtcagctgcaaaatcgccagatgctcacgggtctgtgccatcacgccgtcatcgcacgccaccaccaacagcgcgtgatcgataccaccaacgcccgccagcatgttggaaagaaacttttcatgaccgggaacgtcgataaaaccaggcacgcgaccatccggctgcggccagtaggcatagccgagatcgatggtcatgccgcgctttttttcttccggcagacggtcagcatttacgccagtaatcgcctgcaataaggttgttttgccgtggtcaacgtgtccggcagtcgcaataatcatttcaacaacatctccaaaaaccgttgctcatcttcaaggcagcgtaaatccagccacaatcgtccgtcataaatacgaccaatcaccggcactggcaattcacgccagcgggcggctaatgactcaaggtggctaccgcgtccatcatggggtgtaaacgttaatgccgcgctcggcaggcgatcaaccggcagcgaaccactgccaatctgcgaaagacatggcataacctgtaccgcaaactccgcgccgtaatgtgcggcaaggggggcctgtaaacgttgtgcctggatttgaatgacctctgcgctgcgggtaagcaggcgcagggtcggtaatttttcactcagagcttcagggtgtaaataaagacgcaacgtggcttccagcgccgcgagggtcattttatccgcgcgtaatgcacgcttcagcgggtggctttgcaggcgggcgatcatctcttttttaccaacaataattcctgcctgcggcccgcctaacaacttgtcgccggagaaactcaccagactgacgcccgccgcaatcaactcctgcggcattggctctttcggcaaaccgtactggctaagatcgaccagcgagccactgcctaaatcagtcactacgggaacatccagctctttgccgagcgccaccagttccgcttcatctatcgctttggtgaacccctgaatgctgtagttactggtatgtactttcatcaacagtgcggtattttcattcaccgcctgacgataatcattcgcgtgcgtgcggttggtggtccctacttcgtgtagggtgcagcctgcctgacgcataacatcgggaatacgaaacgcgccgccaatctccaccagttcgccgcgagataccaccacctcttttccgctggcagtggccgccaacatcaataacaccgccgccgcattgttattgacgatacaggcatcttccgcccccgtaatacggcacagcagctgcgccagcgcccgatcgcgatgtccgcgtccggcgtcgtccagatcatactcgagggtcactggcgaacgcatagcctgcgcaacggcttccaccgcggcttccgcctgtaaagctcgcccaaggttggtatgcagcacggttcccgtcaggttgatcaccggacgcagcgcgctctgcgcttctttcgtcaaccgggcatcgacttcttgcgcccagttttcacaccacgcaggcagcgtctggctgccacgaatcacttctcgcgcttcgtcgagcatctgacgcaacaattccaccacgcgggtgtgaccataagtatcacgcaaagaaaggaaggagctatcgcgcaataagcgatcaatagccggaagttgactatagagggaacgcgtttcggttgtcataggaaacctggctgatcaaggccctctcacacggagaagggcgtttaacataaccacggattgtaacgtgagatgggtcaggaggacatatcgcgcatcaagcctttggcggttcggtgcgagcaaaactttcgcggctaaacaggttttcgaccagtttgactaagtgtgggcggtcgacacaccaacctggcgcaacgcggcggaaattgagatatccgacggcacaggcaatggcgatagtcgccagattgaccgtatcggttttgagtgtgccatcgaccagatatccttccagcacatccagactgcggttgattttctcccgctggcgtaacaattcatcttcagactgctgcgccgctggacgcgcctgttcacgcaccgataccagcccggcatccataatgccatccgccagtgcctcaattttgcgcacccgcaacgactccagcggatcgcgcggcaacatcgccggagcgacattcattaattcaatatattcagcgatgatcggcgaatcaaaccaacattcgccctcttcggtcaccagcaccggcacttttcctaacgggttaaattgcgccacgccgttgtccgcgttatagggcagttcattaataaattcgaaagttatgcccttttctaacaacagaatagaaagtttgcgtacaaacgggctggtgtagctaccgacgagtttcatgccgagtcctttgtgcgaggaaaaatatcagtatggcctggtgatgggaaaaagggcagaaaatgttgatggtttgttacttccaaataaatcacatatttatcatggtgatataaatattttcctaattgtttctatctgatggatatctcacttaaggctttcttataaatctgtagggttttgcctggaagcagacaaataacccgataaaacaaggatgagcagatgagcggaaaaccggcagcgcgtcagggcgacatgacgcagtatggcggtagcattgttcagggttcagccggggtgcgcattggtgcccccaccggcgtggcctgttcggtgtgccccggcggagtgacgtccggccatccggtcaatcccctgctcggtgcaaaggtccttcccggtgaaaccgaccttgccctgcccggcccgctgccgttcatcctctcccgcacctacagcagttatggcgacgtgaacgggacctgacgggctggatgtcgctgtcacggaaaccggaagtgacctggtacggctgggacggcgaccggctgaccacgatacagaacgacagaacccgcatccagacgatttatcagccggggagcttcacgccactcatcagagttgaaaccgccaccggtgagctggcgaaaacgcagcgccgcagcctggcggatacccttcagcagtccggcggcgaagacggtggcagtgtggtgttcccgccggtgctggtgcagatgctcgaccggctggaaagtgaaatcctggctgaccgggtgagtgaggaaagccgccgctggctggcatcgtgcggcctgactgtggagcagatgcaaaaccagatggacccggtatacacgccggcgcgaaaaattcacctgtaccactgcgaccatcgcggcctgccgctggcccttatcagcacggaagggacaacagcgtggtacgcagaatacgatgaatggggtaaccagctgaatgaagagaacccgcaccagctgcagcagctcatccgcctgccggggcagcagtatgatgaggagtccggcctgtattataaccgccaccgctattatgacccgctgcgggggaggtatatcactcaggatccgattgggctgaaggggggatggaatttttatcagtatccgttgaatccagttacgaatacagatcctctggggttagaagtttttcctagaccattccccttgccaattccatggcccaaaagccctgcacagcagcaagcagatgataatgctgcaaaagcattgacaaaatggtggaacgatacagcatcacaaagaatatttgactctctaatattgaataatccgggactagcattagatataacaatgatagcttctcgtggaaatgttgcagacacagggataactgatcgtgtcaatgacataataaatgacagattctggagtgatgggaaaaaacccgacagatgtgacgtacttcaggaactaattgattgtggtgatattagtgctaaagatgcaaaaagcacacagaaagcctggaattgtcgtcactccagacagtcaaacgataaaaaaagatagcccttgtggaggttcctgcaatgtcaaatacataccagaaaagaaaggcaagtaaagagtatggtttatataatcaatgtaagaaactaaatgatgatgaattatttcgcttacttgatgatcacaattccttgaaaaggatttcatctgccagagtattacagttaagaggtgggcaagacgctgttagattggcaattgagttctgctctgataaaaattatatccgtagagatatcggagcatttatactcgggcaaataaaaatttgcaaaaaatgcgaagataatgtttttaatattttgaacaatatggcattgaatgataagagcgcttgcgttcgagctacggcaatcgagtcaacggctcagcgatgcaagaaaaacccaatttattcacctaaaatagtagaacaatctcaaattactgcttttgataaatcgactaatgtcagacgtgctacagcatttgctatttctgttatcaatgataaagcaacaattccactattgattaatctgttaaaagatccaaatggagatgtcagaaactgggccgcatttgcaataaatatcaataaatatgataatagtgatattagggattgttttgtggagatgcttcaggataaaaatgaggaagtccgtattgaagcaataatcggactttcctacagaaaagataaaagggttttatctgttttatgcgatgagttaaaaaaaaatactgtttatgatgatatcattgaagctgcgggtgaattaggtgataaaacgctgcttcctgttttagatactatgttgtacaagtttgatgacaatgaaattataacttccgctattgataagctgaagcgttcatagcgtgagttgcctatgcacagtgggggattcccgccggcacggtgcagatgctcgaccggctggaaagtgaaatcctggctgaccgggtgagtgaggaaagccgccgctggctggcatcgtgcggcctgaccgtggagcagatgaaaaaccagatggacccggtgtacacgccggcgcgaaaaatccacctgtaccactgcgaccatcgcggcctgccgctggcgctcatcagcacggaaggggcaacagcgtggtgcgcagaatatgatgaatggggcaacctgctgagtgatgagaacccgcatcatctgcagcagctcattcgcctgccgggtcagcagtatgatgaggagtccggcctgtattacaaccgccaccgctattatgacccgctgcaggggcggtatatcactcaggatccgattgggctgaaggggggatggaatttttatcagtatccgttgaatccggtcataaatgtagatccgcaaggtttggttgatataaatttataccccgaaagtgatcttatccattctgtagctgatgagattaatatcccaggcgttttcacaatcggggggcatggtacccccacatctattgaatccgcaacgcgcagtatcatgacagctaaagatctagcatatctaattaaatttgatgggaattataaagatgggatgacagtttggttattttcttgtaatacaggtaaaggacaaaattcatttgctagccaattagctaaagagttacatacaaatgtaataggacctgacacgctatggacgtggtgggggcgaggaactaatggtaagttaaaaatggatacagtgctaacagcaccaacgaaccttaattcaaataaggatctaatggctataacaacaaaagaccttggtaattggataacatatgggccatctgggcaccccatttctaatatgcaaggtacgccagaaaaacccagtgatataagataggttgtagatgtatgaaagcatgcttgttactatttttttatttttctcttattggtcaattgcatggtgctgatgtgaaaataaaagaaaacgaaagtgtgatgggatctacagcaatgacctatgatttaagtgaagaaaagctgatgaaactgaagtataaatcacaacatggtgattcagaggcatcatttcgactatatcaatattactgctttactaaaaataatattgataaacaattgcgattcttggaaagatcagcatctcaggggaatgttacagcgcagtttaattatggggtctttttatcagatacaaatccaacattatcagaatattataatttgaatagagctatttattggatagaattcgctgtaaataacggtaatattgatgcaaagagcaaacttcaagagctcaaaaagctaaagcgaatggatagaaggaagaataaggagaatccgtaaaagcaatagttcatcagactgccgcagcagtagtatgatgatgaatcagggctgtactataactattatcggtaacattaaccgcagcaggggcggtataacactcaggctccgattgggctggaaggtaggtggaatttttatcagtatccgttgaacccgatttctggaatcgatccccttgggattagccacctgtttatacagcataactttaggtatgctttcgtgtgtttcagatataccatgtgatgataatttttatgatgtgcttagtattccagtcgtttctggtaataatatgcaatgtaaaaataatccccgttgtacacatttataaatagatggccaatacctcaaggcctatggagttggaatgttaatgacccgggagcaagcaatagaaaacctgacggcatacgattagtaccgtcagttaatacaggaacttataatcgcaatggattttcaatacatagttgtttaaacgcttttggtccgtctttaggacctcgattctgttccgagggttgtataactggtttatctaatgacatgcaaaaattaaatgagttaatattttcagagccagatagcacattaacagttacggactaaaaaatatggcaaggttattaacaattgtatttttttctctatttctgcgagtgcagttactgcaagacaatttcagagagagttagatttggcagacaaagcaatattattggcactaatatcagccagtactaaagagggacgaaaagcgtgttcactaagctattttgcctgtaaggccgcagaggctgaactcggactggcatatatggctgcgaatgataacaaggaatttctcacatccttatctaatataatgaggtacaaaatagatgctggactttccgaatcctatacatgctatttattaagtaagggaaagatcataagaccatatctgaaaaatctaaatccactccaacttgccgctgattgcattgaaacagtaaataaaataaaagataagaataaaaaaatcattgatataaattcagttaatatttgtagtgatgataaaaatataaaattgagagttaatagtactattatggccattgatgattctataaagtgcatcgatgaatgataacttaattttatttaaaaatatattaataactcactctccaggagtttttttaacttagttttataatgaatacgataattaaaagtgaagaagaaaatagttgtatacatatattccatgaccctacattgtgatctatagattaaatattttttaaatgtgactgtcatccttcagataataaagccatcatcgcaatagttggaaaagcactcctgctcttttttgattagagccgtcgcaggaggaacaactcatatcatcattgcgatctcgacgatgtatagtctcatcctgcggcagaacaagacggataaaaaatccaatgagagcacactcatccagaacttattaacataatgaatattaaagaaaaatcatcgcagctaatgaagtaatatgcaaaaataattagtccttacaaggagcaaagttccataatctcccccctccccctcaatgatccaaataaagataatgcatccagctggtcattcttagcagcactttccgcatcaccgaaacatggctgaaatggtcggagtaaaccgccacctgggcgtagatgccgtcgggtaaggcatcgatatcatcgttagggtccagttcaatggttcccagcacaccgtccgtgccgggcacgaccgttaatgattgcaataccccctgcgcctgataagaaccgcctggcacgacaggtaaaatactggtcagtttgccgtggaacacctgcccaggtagcgcgttaaacaccacttctgcatcatcaccaggtttcagacgtaacagcgagttttgccgaaattgggcgacaatttgccgtttttgctcggggatgaaaaccatcaccggacgcaacggcaaggcagctgcgtatgtgcctgggcggatcagtacctgagtgacgtagccattgcttggtgcgcgaatgacagtctgctcaagattatattttgcttcagtaagttgcgctcttaagctcacaatctgcgattgctcgccgttaaccatactgtcgagctggctctggatctgcgcctgctccgccaccgagcctttcaccagcgcatcctgcgcgaggaaattttgccgcgcatcgtcgatgtcacgttccgagaacggattcaccgccgcctggctgcctttcagataacgttgataatttttaaacagacggtcgcgctccgctgaaacctgggtggtgttggcctgcgcttctgtgagctgcgcgcgcagagtctttatattatgcgtcgccgtcatcaggtcagcctgaagcctgtcaactcgcgcctggtaacgaaccgggtcgagcttaaaaagcacctcgcccttttgaataagctgattattcttgtcagtgacttcagtaacaattcccgtcacctgtggcgtgatggggatcgctatcactgccttttgcgcggtaaaagtgtaagggtggttgtagttcatcaacaaaatcaaaccactcaccagaaacacgccacccagcgccgccgtcgccagcgtccactgattcaccggaatacgaaagattttaaagaccgcccacgccagcgccacgtaagttaaaacaatcaatagatccataattagatctccgggaacgtggaatagtcagtctttttctcggcggcgagttgatgctccagccgggaaattcggtcagaaagtgcggcgatttccgggtcagtcgctttctcctgcgacgcaacatgtgactgcatgccccacccgcgctccggttgatagagcgtcgcccagatccacaggaacggccagataacatgcagagtaaacaggctcacccagcccgccgtatgaatagcgtcggcatggggatggttgcgctttttggcaatcagataagggatgtcatgtatcgcgatgattccataaaaaatcaccagaaagacgaagatcagcactcccaacgcgaaatagtttagaaacatatctgcctcggattcacgtttatcagtgttgtttttgggctggcagccagaagggagtcaggctgatattttgacaataatccgggttcgcgattctcgccataacaccaaagaataatttttagaggtgatgagttgcttagttacataacgattgtatgacgaaggcataacatgctgtagatcacatcaggtgaacgccgtaagaaaatatcttgtgattcagatcacaaagattcaacaaaccatcaaaacaaaaatgtgacattactcacatttaaatgccatttttagcgaaaatcgccgccttgttgcttttttacacaagcgttttgtgatgagcatcacgtcaattacctctctaccccctatatttatgtgactgatatcacacaaaaggccgtcgactggacagttaaccgattcagtgccagatttcgcagtatctacaaggtccggctacctctgccgctacattaacaaaaaacctcgggcttccagcctgcgcgacagcaaacataagaaggggtgtttttatgtcatccgatattaagatcaaagtgcaaagctttggtcgtttcctcagcaacatggtgatgccaaatatcggcgcgtttatcgcgtggggtatcatcaccgcattatttattccaacagggtggttaccgaacgagacgctggcgaagctagtcggaccgatgatcacttacctcctgccgctgctgatcggttataccggtggtaagctggtaggcggcgaacgtggcggcgtagtcggtgccatcaccaccatgggcgttatcgtcggcgcagacatgccgatgttcctcggttctatgattgcaggtccgctgggcggctggtgcattaagcacttcgaccgctgggtagacggtaagatcaaatccggttttgagatgctggtgaataacttctccgctggcatcatcgggatgatcctcgccattctggcattcctcggcattggcccgattgttgaagccctgtccaaaatgctggctgcgggcgttaacttcatggttgtccatgacatgctgccactggcatctatctttgttgaaccggcgaaaatcctgttcctcaacaacgccattaaccacggtatcttctcgccgctgggtattcagcagtcccatgaactgggtaaatccatcttcttcctgattgaagctaacccaggtccaggtatgggcgtgctgctggcgtacatgttctttggtcgtggtagtgctaaacagtctgcgggcggtgcggcaatcatccacttcctgggtggtatccacgaaatctacttcccgtatgtgctgatgaatccgcgtctgatcctggccgttatcctcggcggtatgactggcgtgttcacgctgactatcctgggcggtggtctggtttctccagcatctccggggtctatccttgcggtactggcgatgacgccaaaaggtgcttacttcgctaacatcgcgggtgtgtgtgcggcgatggctgtctccttcgttgtctctgctattttgctgaaaaccagcaaagtgaaagaagaagatgatattgaagcagcaactcgtcgtatgcaggacatgaaagctgagtctaaaggcgcatctccgctgtctgctggcgatgtgactaacgacctgagccacgtacgtaaaatcatcgttgcctgtgacgccggtatgggttccagtgcgatgggcgcaggcgttctgcgtaagaaaattcaggatgcaggtctgtcgcagatttctgttactaacagcgcgatcaacaacctgccgccagatgtggacctcgtcatcactcaccgtgacctgaccgaacgcgctatgcgccaggttccgcaggcacagcatatttcgctgaccaacttcctcgacagcggcctgtacaccagcctgaccgaacgtctggttgctgcccaacgccacacggcaaacgaagagaaagtaaaagacagcctgaaagacagctttgacgattccagtgctaacctgttcaagctaggcgcggagaacatcttcctcggtcgcaaagcggcaaccaaagaagaagcgattcgttttgctggcgagcagctggtgaaaggcggttacgttgagccggaatacgttcaggcgatgctggatcgtgaaaaactgaccccgacttatctgggtgagtctatcgcggtgccacacggtacggttgaagcgaaagatcgcgtactgaaaacgggcgtcgtgttctgccagtacccggaaggcgtgcgcttcggtgaagaagaagatgacattgcccgtctggtgattggtattgctgcccgtaacaacgagcacattcaggttatcaccagcctgaccaatgcactggatgatgagtccgtcatcgagcgtctggcacacaccaccagcgtggatgaagtgctggaactgctggcaggtcgtaagtaatccaatcccaccctctccacatggagaaggtggggttaattgcctgatgcgctacgcttatcaggcctacaggatgcatcacaatttgttgaatttgcacgttcttgtaggccggataaggcgcttacgccgcatccggcgctgcccctctcctcacggagagggtttgggtgagggaaaagcctcaccccagccctctcgggtaaaaacattgatgaaggttaatactatgaaagcattacattttggcgcaggtaatatcggtcgtggctttatcggtaaactgctggcagacgcgggtatccaactgacgtttgccgatgtcaatcaggtggtacttgatgccctgaatgcccgtcatagctatcaggtacatgtggttggtgaaaccgagcaggtagataccgtttccggcgtcaatgctgtcagcagcattggtgatgatgtcgttgatctgattgctcaggttgatttagtcactaccgccgttggcccggttgtgctggaacgtattgctccggcaatcgccaaagggctggtgaaacgtaaagaacaaagtaatgaatccccgctgaacatcatcgcctgtgaaaacatggtacgcggtaccacgcagctgaaaggccatgtgatgaacgccctgccggaagacgccaaagcgtgggtagaagaacacgttggctttgtcgattccgccgttgaccgcatcgtaccgccttcggcttcggcaactaacgatccgctggaagtgacggtagaaactttcagcgaatggattgtcgataaaacgcagttcaaaggcgcactgccgaacatcccaggcatggagttaaccgacaacctgatggcatttgtcgaacgtaaactcttcaccctgaacacgggtcatgctataaccgcgtacctcggaaaactggccggtcatcagaccattcgtgacgcgattctcgacgagaaaatccgcgcggtggtaaaaggtgcgatggaagaaagtggtgcagtattgatcaagcgctacggctttgacgctgacaagcatgcggcgtacatccagaaaatcctcggtcgttttgagaacccgtatctgaaagatgatgttgagcgcgtaggccgtcagccgctgcgtaaactgagtgctggcgaccgtctgatcaagccactgctcggtacgctggaatatggtctgccacataaaaacctgattgaaggtattgccgctgcaatgcacttccgcagtgaagatgatccgcaggctcaggaactggcagcactgatcgctgacaaaggtccgcaggcggcgctggcacagatttctggtcttgatgccaacagcgaggttgtatccgaggcggtaaccgcttataaagcaatgcaataatggtggaccaggcgcaggacaccctgcgcccgaataacagattgtcagatatgcaggcaacaatggaacaaacccaggcctttgaaaaccgtgtgcttgagcgtctgaatgctggcaaaaccgtgcgaagctttctgatcaccgccgtcgagctcctgaccgaggcggtaaatcttctggtgcttcaggtattccgcaaagacgattacgcggtgaagtatgctgtagaaccgttactcgacggcgatggtccgctgggcgatctttctgtgcgtttaaaactcatttacgggttgggcgtcattaaccgccaggaatacgaagatgcggaactgctgatggcattgcgtgaagagctaaatcacgacggcaacgagtacgcctttaccgacgacgaaatccttggaccctttggtgaactgcactgcgtggcggcgttaccaccgccgccacagtttgaaccagcagactccagtttgtatgcaatgcaaattcagcgctatcaacaggctgtgcgatcaacaatggtcctttcactgactgagctgatttccaaaatcagcttaaaaaaagcctttcaaaagtaagcaacgtctgcttactgcccctctacctgcttcggccgataaagccgacgataatactccagacgttgtagatataacggcacgctttcatcgggtattccggacggaatcgcgttacggggaggaagttttttcagatactcccggaacgcctggcttgatgccatgaaatctacggctttatcgataagaagcggaacgttttcacctaatttgcccatgatgatatctccgtattaccccgcgccgggaatgcgcggccgccaattttagtttaggttcccggtaaagatgacattaaggaaaacgtgctgaatcctcaataatcatccgctgctgtttattatcttttttctatagatttcttaattaatcaacgaattgcgtagtttttgagcatgttaatgattacgttgcagaactattacaatgtcatcagttgtgaacaaagcacttggtcgcgcatactaggggctataaatttatctttatcagaagccatcacatgaaagaagtcgaaaaaaacgaaatcaaacgtctcagcgatcgcctggacgccatccgccaccagcaggccgatctgtcgctggttgaagccgcagacaaatatgccgagctggaaaaagagaaagccacgctggaagcagaaattgctcgcctgcgtgaggttcatagccaaaaactgagtaaagaagcacaaaaactgatgaagatgccgtttcagcgcgcaattaccaaaaaagagcaggctgatatgggcaagctgaagaaaagtgttcgcggactggtggttgtgcacccaatgaccgcactgggccgtgaaatgggcctggaagagatgaccgggttttcaaagaccgcgttttaagcccctcagacgactggtacgatcgtatcaacccgcatctgacttgcgttagctggtcaatgcggggactctcctgtctactcgcctaatgaccaaacaattcactccccttacgtcgatttaccgctggttgatattctgaaaatgcatctttaccgaaataaccacctataaacaataaaaatatatagaagatatcatttattaattaacaagcagttacgtctctttttttcggatttaattgtgaaattttaatcatcatattcatacaatcaattatctgtaaaatttttcccatacatggtttctttcatatttgacatttattaataatcatcattagaatccacgaaaaatattatattcatacaaacacagacatcttttgaaactaatgatacatttttatgatgaatgcttaaaacaatatttaatcgacacacatcactgtcattaatgtaaagcaacatagatcaccaataatacaatggacaactctaccggcattgatcgctggtcggaggcaataaggattttcacatgaacttgaagaagatttttttcagtgctgtcactgtttcagttctctgcgcattaacgggatgtgactacattcaagaaggcaagccagaaagtagtttactgaaacaagaagaagaacataacaataaaattgtgctacttgaaaaacaacaagcacagctaaagagtcaactcgaaactattcaaaaacaacaaactggcataataaacagcacaaagactttaactcacgtaattaaatccgttaaagaccaacaaaatacttttatttttaccgagtttaacccagcaaaaacgaagtatttcatcctgaacaacggttcggtggctttagcgggccgagtgttatccattgacgccacagagaatggcagtgttattcatatttcactggtcaacttattaagtataccaatctcaaacattggctttaatgcgacatggggtggtgaaaaacctgtcgatgccaaagagtttgcccggtggcaacaattacttttcaacacatcaatgacatccacattgaaattattaccaggtcaatggcaagacattaatttgacactgaagggtgtatcgccaaataagctgggatatctgaagttagccatcaatatggaaaatattcagtttgacaatcttcccgctgctgataatcggcagaaaagaagcaaaaaataaatgcaattagtacgcttataacaaggaatagcgagcatcattaatgaacaaaatatttaaagttatctggaaccctgccacagggaattatactgttaccagcgaaacggcaaaaagccgtggcaagaaatctgggcgcagtaagctgttaatttctgcgctggttgcgggtgggttgttgtcatcgtttggggcgctggctgataattacgacggtcagggcgttgattacggcgatggctcagctagtgacggctgggttgctatcggtaaaggtgcaaaagcaaatatttttttaaacaacgctggtgccagtaccgctttaggttatgacgctatagctgaaggccaatatagctctgccatcggctcaaaaacccatgctattggtggtgcatcaatggcctttggggttagtgcaatctctgaaggtgacaggagtatcgcgctgggtgcatcgtcgtattcattcggccaatactcaatggcccttggtcgttattccaaagcgctgggtagattgtctatagctatgggggatagctccaaagcggatggagcaaacgccattgcgctgggaaatgccgctaaggcggctggtattatgagcatcggtctcggtgataatgccaatgcgtcacaagattatgctatggcgctgggagcagaaagcgaagccgctgaaaatgcgaccgctatcggcaataaagcgcatgcaaaaggagtgaatagcatcgcgttgggtaatggcagccaggctctggcagatagtgcaattgctattggccagggcaacaaggctaacggcgctgatgctatcgctctgggtaatggtagccagtcgagtggcttaaacgctattgccttaggtaaggccagtgttgtaactggcgataatagtcttgcgcttgggagcaataccaatgccaacggtattaactctgtcgcgctgggcgcaggttctattgcggatcaagacgatagcgtttctgtcggcagtgactcattacaacgcaagatcgttaatgtaaaaaatggcacgatcaaggctgatagccacgacgccattaatggctcacagctttatgccatcagcgactcggtggcaaaacggcttggcgggggttcatcggtaaacgttgacgacggtactgttaaagcaccaacctacaatttaaaaaatggtaacaaaaataacgttggcgatgcgctcactgtactcgatcaattcaccctgcaatgggatcaaaacagagacaaatacagcgccgctcatggtagctcaactgccagcgtaatcaccgatgtggcggatggcgcagtttcagattccagtaaagacgcggttaacggttcacaactgaaagccaccaatgatgatgttgagaccaataccaccaatatcgctaccaataccggaaatattgcaactaacactgcaaatattgctaccaacaccaccaatatcactaatttgacagatactgttggcgaccttaaagatgatgccctgctctggaatggcactgcattcaacgccgctcatggtacggaaaccaccagcaccatcaccaacgtgaaagctggtaccctttcggatgacagtactgacgcggttaatggctcgcaactgaaagacactaacgataacgtggcgaccaacaccaccaatatcgctagcaacacggctaacattgccactaacaccagtaatattgccgataacactgccaacattgctaccaacaccagtaatattgccgataacactgccaacattgcgaccaacaccagcaatattgcaggtaacactgccaacattgctaccaataccactaatatcgcggctaacaccacaagcataaatagcctgaacacgtctgtggatgctcttgaacaggatgctatgctctggaacggcactgcattcaacgccgctcatggtacggaaaccaccagcaccatcactaatgtgaaagctggcaccctttcggatgacagtactgacgcggttaatggctcgcaactgaaagctactaacgataacgtggcaaccaacaccaccaatatcgccagcaatacggctaacattgcgaccaacaccgccaatattaatactctcaatacgtcgatcgatacccttgagcaggatgcaatactctggaacggaacagcgtatagcgccgcgcacggtacagaaacagccagcactattaccaacgttaaagcaggtactttatctgaaaatagtacggacgcagttaacggtgcgcagctgaacgcgactaacgcgaatgtggcgaccaacaccaccaatattgctactaacaccgccagcattaatactctgaatacatccattgacgctctggaacaggatgcgctgctttgggatggcactgcattcagtgcagcgcatggtgcaaacaaagatgccagcaaaatcaccaatgtcctggcagggactgtatcatccgccagtactgatgccattaatggcagccagcttcatgggttgagcagttcgatcgccacctatcttggtggtggtgccactgtgagcgattctggcgtatttagcggccctacctataacattgatggtaatgattacaccaatgttggtgctgcacttgacgccattaacacctcacttagcgactcactcggcgatgccctcctttgggatagcacgactggcgcatttagtgccaaacacggttctaccgccagcgtaatcactaacgtcgcagacggtgcagtctctgactctagctctgatgctgtgaatggttcacaactgtacgatgtaagcaactctgttgtcgatgttctgggtggtggtgctggcgtgaatacggatggcagcatcagtgcaccaacgtacaccattgctaacactgattacgataatgtcggcgatgccctaaacgcgcttgataccactcttgacgatgcgatgctatgggatgctaccgcaggtgaaaatggtgccttcagtgccagccacgatggcagtgccagcaaaataactaacgtcgcggcaggaacaatttctgacaccagcaccgatgcggttaatggggctcaactccacggcgttagcagttccgtcgctgaggctcttggtggtggtgcggcggtgaattctgacggcagcatcagcgcaccgacttacaccattgctgataccgactataccaacgtcggcgatgcgatgaatgcaattgactcaaccctggataacgccttgctttgggacgctaccgcaggtgaaaacggtgcgtttaacgccagccatgatggcaaagccagtgtcatcaccaacgtagccaatggtcagattaacgaaaccagcaccgacgcggttaacggttcccagttaaatgccacgaatatgttgatccagaatattgccggtgataccagcgaaagctatatcacagagaacggtgaaggtatcaactatgtgcgtactaacgacagcggcttagtctttgaggatgccagtgctacgggtgtgggcgctacagctgtaggttataactccgtcgcatcaggcgatagcagtgtggcaattggacagaacagcagcagtactattgaatctggaattgctctgggcagcagttctgtgtctaaccgtgtcatccttcagggctcccgtgataccagcgtaaccgaagatggcgtagtcattggttataacaccagtgatggcgaactgcttggcgcgttgtcaattggtgatgacggtaaatatcgtcaaatcatcaacgtcgccgatggttccgaagcccatgacgccgttacggttcgccagttgcagaatgcgattggtgctgtagcaacgacaccgtccaaatacttccatgctaattcaacggaagaagattcactggctgtcggtgaagactcactggcaatgggtgcgaaaaccattgttaatggtgatgccgggatcggtattggcctgaacactctggtgttaactgatgcaatcaacggtattgctatcggtagcaacgcgagtgcaaatcatgcaaacagtattgcgatgggtagtggttcccagaccacccgtggtgcgcagactgactacaccgcctacaacatggacgcgccgcagaattctgtcggtgaattctctgtcggcagcgaagacggtcaacgtcagatcaccaacgtcgcggctggttcagcggataccgatgcggttaacgtaggtcagttgaaagtcactgatgagcgcgtagcgcaaaatacccagagcattactaacctgaacaatcaggtcactaatctggatactcgcgttactaatatcgaaaacggtattggcgacattgtcaccaccggtagcaccaagtacttcaagatcaacaccgatggcgtagatgccaacgcccagggtaaagatagcgttgctattggttctggttccattgctgccgctgacaacagcgtcgcactgggtaccggttccgttgcagatgaagaaaatacaatctctgtaggttcttccactaaccaacgccgtattactaacgttgccgcaggtaaaaatgctaccgatgctgttaacgttgcgcagttgaagtcttctgaggcgggcggcgtgcgttacgacaccaaagctgatggttctatcgactatagcaatatcaccctcggtggcggcaacggtggtacgactcgtatcagcaacgtctccgctggcgtcaacaacaacgacgcggtgaactacgcgcagttgaagcaaagcgtgcaggaaacgaagcaatacaccgatcagcggatggttgagatggataacaaactgtctaaaaccgaaagcaagttgagtggtggtatcgcttctgcaatggcaatgaccggtctgccgcaggcttatacaccgggtgccagcatggcttctattggtggcggtacttacaacggtgaatcggcagttgctttaggtgtatcgatggtgagcgccaatggtcgttgggtctacaaattacaaggtagtaccaatagccagggtgaatactccgccgcactcggtgccggtattcagtggtaatgatccattaagttagtgtgactaagggcaaacgccaaattgcctgatgcgctacgcgcatcaggcaagataaggcgctctggatcaacaacctaagggcaattctctgatgaggattgcccttttctttaccagacatctccccccacaagaattggccctaccaattcttcgcttatctgacctctggttcacaatttcccaattaaaactcacatcaatgttgccaatacataacatttagttaaccattcattgtcattatccctacacaacacaattggcagtgccacttttacacaacgtgtgacaaggagatgagcaacagactcattacacgatgtgcgtggactccaggagacctgcaatgaatctctggcaacaaaactacgatcccgccgggaatatctggctttccagtctgatagcatcgcttcccatcctgtttttcttctttgcgctgattaagctcaaactgaaaggatacgtcgccgcctcgtggacggtggcaatcgcccttgccgtggctttgctgttctataaaatgccggtcgctaacgcgctggcctcggtggtttatggtttcttctacgggttgtggcccatcgcgtggatcattattgcagcggtgttcgtctataagatctcggtgaaaaccgggcagtttgacatcattcgctcgtctattctttcgataacccctgaccagcgtctgcaaatgctgatcgtcggtttctgtttcggcgcgttccttgaaggagccgcaggctttggcgcaccggtagcaattaccgccgcattgctggtcggcctgggttttaaaccgctgtacgccgccgggctgtgcctgattgttaacaccgcgccagtggcatttggtgcgatgggcattccaatcctggttgccggacaggtaacaggtatcgacagctttgagattggtcagatggtggggcggcagctaccgtttatgaccattatcgtgctgttctggatcatggcgattatggacggctggcgcggtatcaaagagacgtggcctgcggtcgtggttgcgggcggctcgtttgccatcgctcagtaccttagctctaacttcattgggccggagctgccggacattatctcttcgctggtatcactgctctgcctgacgctgttcctcaaacgctggcagccagtgcgtgtattccgttttggtgatttgggggcgtcacaggttgatatgacgctggcccacaccggttacactgcgggtcaggtgttacgtgcctggacaccgttcctgttcctgacagctaccgtaacactgtggagtatcccgccgtttaaagccctgttcgcatcgggtggcgcgctgtatgagtgggtgatcaatattccggtgccgtacctcgataaactggttgcccgtatgccgccagtggtcagcgaggctacagcctatgccgccgtgtttaagtttgactggttctctgccaccggcaccgccattctgtttgctgcactgctctcgattgtctggctgaagatgaaaccgtctgacgctatcagcaccttcggcagcacgctgaaagaactggctctgcccatctactccatcggtatggtgctggcattcgcctttatttcgaactattccggactgtcatcaacactggcgctggcactggcgcacaccggtcatgcattcaccttcttctcgccgttcctcggctggctgggggtattcctgaccgggtcggatacctcatctaacgccctgttcgccgcgctgcaagccaccgcagcacaacaaattggcgtctctgatctgttgctggttgccgccaataccaccggtggcgtcaccggtaagatgatctccccgcaatctatcgctatcgcctgtgcggcggtaggcctggtgggcaaagagtctgatttgttccgctttactgtcaaacacagcctgatcttcacctgtatagtgggcgtgatcaccacgcttcaggcttatgtcttaacgtggatgattccttaatgattgttttacccagacgcctgtcagacgaggttgccgatcgtgtgcgggcgctgattgatgaaaaaaacctggaagcgggcatgaagttgcccgctgagcgccaactggcgatgcaactcggcgtatcacgtaattcactgcgcgaggcgctggcaaaactggtgagtgaaggcgtgctgctcagtcgacgcggcggcgggacgtttattcgctggcgtcatgacacatggtcggagcaaaacatcgtccagccgctaaaaacactgatggccgatgatccggattacagtttcgatattctggaagcccgctacgccattgaagccagcaccgcatggcatgcggcaatgcgcgccacacctggcgacaaagaaaagattcagctttgctttgaagcaacgctaagtgaagacccggatatcgcctcacaagcggacgttcgttttcatctggcgattgccgaagcctcacataacatcgtgctgctgcaaaccatgcgcggtttcttcgatgtcctgcaatcctcagtgaagcatagccgtcagcggatgtatctggtgccaccggttttttcacaactgaccgaacaacatcaggctgtcattgacgccatttttgccggtgatgctgacggggcgcgtaaagcaatgatggcgcaccttagttttgttcacaccaccatgaaacgattcgatgaagatcaggctcgccacgcacggattacccgcctgcccggtgagcataatgagcattcgagggagaaaaacgcatgattatttccgcagccagcgattatcgcgccgcagcgcaacgcattctgccgccgttcctgttccactatatggatggtggtgcatattctgaatacacgctgcgccgcaacgtggaagatttgtcagaagtggcgctgcgccagcgtattctgaaaaacatgtccgacttaagcctggaaacgacgctgtttaatgagaaattgtcgatgccggtggcactggctccggtgggtttgtgtggcatgtatgcgcgtcgtggcgaagttcaggcagccaaagcggcggacgcgcatggtattccgtttactctctcgacggtttccgtttgcccgattgaagaagtcgcgccagccatcaagcgcccaatgtggttccagctttatgtactgcgcgatcgcggctttatgcgtaacgcgctggagcgagcaaaagcagcgggttgttcgacgctggttttcaccgtggatatgccgacaccgggcgcacgctaccgtgatgcgcattcaggtatgagcggcccgaacgcggcaatgcgccgctacttgcaagcggtgacacatccgcaatgggcgtgggatgtgggcctgaacggtcgtccacatgatttaggtaatatctcagcttatctcggcaaaccgaccggactggaagattacatcggctggctggggaataacttcgatccgtccatctcatggaaagaccttgaatggatccgcgatttctgggatggcccgatggtgatcaaagggatcctcgatccggaagatgcgcgcgatgcagtacgttttggtgctgatggaattgtggtttctaaccacggtggccgccagctggacggtgtactctcttccgcccgtgcactgcctgctattgcagatgcggtgaaaggtgatatagccattctggcggatagcggaattcgtaacgggcttgatgtcgtgcgtatgattgcgctcggtgccgacaccgtactgctgggtcgtgctttcttgtatgcgctggcaacagcgggccaggcgggtgtagctaacctgctaaatctgatcgaaaaagagatgaaagtggcgatgacgctgactggcgcgaaatcgatcagcgaaattacgcaagattcgctggtgcaggggctgggtaaagagttgcctgcggcactggccccgatggcgaaagggaatgcggcatagtcgtttgcgccccctccccctaaccctctccctcagggagctgtctcttgatcagatctcctgatcaagagacagggggaggccggggtgaggggaaaaggccgcactgctcaccaattttctgctatcctgcccccgcactaagggggcagtatgctaaacatcgtactttacgaaccagaaattccgccaaatactggcaacatcatccgtctttgcgctaataccggctttcgtctgcatatcatcgaaccgatgggatttgcctgggacgataagcgcctgcgccgcgcggggctggactatcacgagtttaccgccgttacgcgtcatcatgactttcgcgcgttcctcgaagcagaaaatccccagcgcctgtttgccctcaccacgaaaggtacgcctgctcacagcgccgtaagctatcaggatggcgattatctgatgttcggcccggaaacacgcggcctgccagcgagcattcttgatgccctgcccgctgaacaaaaaattcgcattccgatggtgccggacagccgcagcatgaacctgtccaatgcggtgtcagttgtggtgtatgaagcctggcggcagctgggatatccgggagcgttgttgagagattagttactgtatgccggatagatgattacatcgcatccggcacgatcacaggacattagatcccatccccatactcaaatgtatggttaataccgttgaaatgctggtccatatccattgatggcttatcgctgtctggtttaccgacaatacgagccggaacgccagcggcggttgtatgcggcggcaccggttgcagcaccacggaacctgcgccaatcttcgcgccgcgaccaacttcaatattgccgaggattttcgcgcccgcgccaatcatcacaccttcacgaattttcgggtgacggtcaccaccagatttacccgtaccgccaagcgtcacagattgcagaatcgatacgtcgttttcaattaccgccgtttcacccacaacgatgcccgtggcgtggtcgagcataatgccacggccaatttttgctgccgggtgaatatcgacctggaacgtcacagaaacctggttttgcagaaagattgccaatgcgcgacgcccctgattccacaaccagtgaccgatgcgataggcctgcaaggcatgaaaacccttcaggtataacaacggggttgagtatttatcgactgccgggtcgcgggtacgcaccgcctgaatatcacaggccgcagaggcgatcatttccgggtcagcggcgtaggcttcttccaccacttcacggatagcaatagcaggcataattggcgatgacagcttgttcgccagcatgtagctcagtgcacttccaaggttttcgtgcttgagtagcgtcgcgtggtaaaaactggccagcattggctcacagtccgccagcgttctggcttcggctttaatattgttccagacaatttccagttcttcacacgacattgcttactccacacgatgagataatgaccggcccgttctgcgcgggccgggtcatagcggtaacaaaggttccctggggttagtggctgctgcgctcgtccttgcgtgcacgacctaataacgtcaatgctgcctcgcgcgcgttttttccgcaatataatacttgataaatttcctcggttattggcatttctacgccgaagcgatgcgccagttcgcggacttctttcgtattgcggtagccttccaccacctgaccaatcttctcctgcgcgctttgtacatccatgccctgaccgagcatcatgccaaaacggcggttacgcgactggttgtcggtacaggtaagcaccagatcccccagccccgccatgcccataaaggtggcaggatcggcacccagcgccgcgccaagacgcgacatttcagccagcccacgggtgatcagcgccgtacgcgcattcgcaccaaaaccgataccgtcggacatccccgcaccaatggcaatgacgtttttcaccgcgccgccaagctgcacgccaatgaaatccgggttactgtaaacgcggaaacttttgccgcagtgcagcagctgctgaagatcatcagcaaaggtctgatcggtcgaggccagcgaaatagctgtcggtaaacctgccgccagttctttcgcaaacgttgggccagagataaccgccagcggaatttgatcgcctaacgcctcgcgggccacgtcctgtaacagacgcccggtttccgcttccagccctttggtcgcccacaccagacgcgcatcaggacgcatcagcggtttaatctggcgcagcacttcaccaaagacatggctgggtacgacgacgagaatattacggctggctgccagcgcagtggcgagatcgctttcaagatggagcgtatcgggaaaaggcacatcggggagaaacgcggcgttacagcggtcgcgttcaagcgttgcgatatgttcagggtcatggccccagaggacaacctcgtggccatttcttgccagggtaatggcaagagcggtgccgtacgagccggcaccgatcacagtcattgaagcattacgttggttcatcaggcatcctgatgttcttcagtaccttcgccagcctgctgctgcaaatagttcatgaacagcgcatcgaagttaaccggcgcaaggttcagttgcgggaatgtaccgcgggataccatgctggtgatgcactcacgagcatacgggaacagaatgttcgggcagtatgcgcccaggcaatgtgccatctgggtgccttcgatacccgcgatggagaaaataccgccctgctgaacttcacacaggaacgcggtttcttcgcccagggaggccgttacggtaacacgcagtaccacttcgtatacgtcatctgccagttgggaagatgccgtatccagatcaagtttaacttctggttgccaatctttctggaaaacgtgcggcgcgttcggcgcttcgaaagagatatccttggtataaatacgttggatctggaaagtcatttcagtgttgttttgttctgacatgtgtagaaaacccttaagtgttgtccttaaatactgcgcaatgtaatgccaacgttcacacgttatttcagcaggggatccagtccaccacgtgcatccaatgcatacaagtcatcacagccgccaatgtgctgtgcgtcaataaaaatctggggaaccgtggtgcgaccgctgcgtttgatcatctcttcacgcttggcggcattgccatcgatcggcaactcctgaaaactcacgcccttgctgctcagcagtgcttttgcacgatggcaatacgggcaggtttctttggtatagatttcaacattggccataatttagctcctgtttttttaccctgaaatttcatgttgcagggcggctgcaaaatggagtgtccccagaagcttataacaataagtcgctgggggcctaattgcagctaacggcctgcatcatgaaagacgacaggtaaattatttgccgcgcaccagaggcaagttttcgccagcccagccagcaacgccctctttcagcacgaatacttgcgcaaaaccagctttcgtcagcgcgtttgcaggctcctggcactgcatgccagaaccgtctaccacgataaccggtttgtctttgtgcttctcaagctcaccaacattgttggctttgatttcgctcggcaacagattgatagaacctgcgatatggcctttacggaagtcatcacgctgacgtaaatccacaaccacagcgtcttctttgttgatcagacgcgtagcttcaccacgagtaatcaccttcactttcgaggtcaggctcttaaacgtagtcacaagaaccgccaccagtaacgcgatccaggcgatactcagtatgggatgacggccaacaaattgcataatttcttgcatggggggtaacaactcccgacgtagtgattaaaaaaaccaggaaaggagtatacctgcgcggtgcggcaaatacagccagcgtgttaactggaatgcaattttgcggggcacgacgaaaaaaaagctcaaatctggcatcggcttgccgcgagcggtcgtatattttgatcttcagaggctattttatcgattcagctgtagtaaaattacgcaaattttgactcttgagtatgaggttgtcgcaatgtcggtttctaaaaaacctatggtactggtgattctggatggctatggctatcgtgaagaacagcaggataacgccatttttagtgctaaaaccccggtaatggatgcactgtgggccaatcgtccgcataccctgatcgacgcttccggtctggaagtcggtctgcctgaccgtcagatgggtaactccgaagtaggccacgttaacctgggtgccggccgcatcgtgtatcaggacctgactcgtctggacgttgaaatcaaagatcgcgctttctttgctaatccagtgctgactggcgcggtagataaagcgaaaaacgcaggtaaagcagtacacattatgggtctgctctccgcaggcggcgtacacagccacgaagatcacatcatggcgatggtagaactggcagctgaacgcggcgcagaaaaaatctacctgcacgcattccttgacggtcgcgacaccccgccgcgcagtgctgaatcctcgctgaaaaaatttgaagagaaatttgctgcgctgggtaaaggccgcgtagcgtccatcattggtcgttactacgcgatggaccgcgataaccgttgggatcgcgttgaaaaagcctatgacctgctgactctggcgcagggtgagttccaggccgatactgccgttgctggtttgcaggcagcttatgctcgcgacgaaaacgacgagttcgtgaaagcgaccgttattcgtgcagaaggtcagccagatgcggcaatggaagacggcgatgcgctgattttcatgaacttccgtgctgaccgcgcgcgcgaaatcactcgtgcattcgtaaacgcagatttcgacggcttcgcgcgtaagaaagtggttaacgtcgatttcgtgatgctgaccgaatacgccgctgacatcaaaactgcggttgcttacccacccgcttccctggttaacaccttcggcgagtggatggcgaaaaacgacaaaactcagttgcgtatttccgaaaccgaaaaatatgcccacgttactttcttcttcaacggtggcgtagaagagtcgttcaaaggcgaagatcgcattctgatcaactcaccgaaagtggctacctacgatctgcaaccggaaatgagctccgcagagctgaccgaaaaactggttgcggcaatcaagagcggcaaatacgacaccattatctgtaactatccgaacggcgacatggtaggtcacaccggggtgatggaagcggcggttaaagcagttgaagcgctggatcactgcgtggaagaagtcgcgaaagcggttgagtccgtgggtggacaactgctgatcaccgctgaccacggtaacgctgaacagatgcgcgatccggcaacgggtcaggcacacacggcacacaccaacctgccagttccgctgatttacgttggtgataagaacgtgaaagcggttgcaggcggcaaactttctgacatcgcgccgaccatgttgtcgctgatgggtatggaaatcccgcaagagatgactggtaagccgctgttcatcgtggaataatccctccccatgaggggaaaggcgattaataccatgacacgggccgtgaaaccgcgcaggtttgcaatcaggcccatcatctacgccagcgttcttagcgctggcgtattgttgtgcgccttttccgcccacgcggatgagcgtgaccaactcaaatctattcaggctgacatcgccgcaaaagagcgcgcggtacgccaaaagcaacaacaacgcgcaagcctgctcgcacaattgaaaaagcaggaagaagcgatctctgaagccactcgcaaactgcgcgaaacgcaaaacacgctcaatcaactcaataaacagattgatgagatgaacgcgtcgattgccaaactggagcagcaaaaagccgcccaggagcgcagcctcgccgcacaactggatgccgcattccgtcagggcgagcataccggtattcagctaattctcagcggtgaagaaagccagcgtggacagcgtttacaggcttatttcggctatctcaaccaggcgcgacaagaaaccattgcccagttgaagcaaacgcgtgaagaagtcgccatgcagcgtgctgaactggaagagaaacaaagcgagcaacaaacgctgttatatgaacagcgcgcccaacaggcgaaactgactcaggctctgaacgagcgtaaaaagacgctggcggggctggaatcttccatccagcaaggtcagcagcagctaagtgaactgcgtgccaacgaatcccgtctgcgtaacagcattgcccgtgcggaagccgcggcgaaagcgcgtgctgaacgagaagcgcgtgaggcccaggcggttcgcgaccgccagaaagaagcgacgcgcaaaggcaccacctataaaccgaccgaaagcgaaaaatcgctgatgtcccgaactggtggcctgggcgcgccgcgtggtcaggcattctggccggttcgcgggccgacgctgcatcgctatggcgaacagctacagggtgaattacgctggaaagggatggtgattggtgcctctgaaggtactgaagttaaagcgattgccgacggtcgggtgattctggctgactggctgcaaggctacggtctggtggtggtggttgagcatggtaaaggcgacatgagtctttacggctataatcagagcgcactggtgagcgttggttcgcaggttcgcgcgggccagccaattgcactggtgggcagcagtggcggtcagggtcggccttcactctatttcgaaattcgccgccagggtcaggcggtcaatccacagccgtggttgggaagataagttttgtttccatttcgtcgtaacgttcttgcatttgccgctctgttggcgctctcctcccccgtacttgctggcaaacttgccatcgtcattgatgattttgggtatcgcccgcacaacgaaaaccaggtgctggcgatgccttccgctatctccgtcgctgtattacccgattcaccgcacgccagagagatggcgaccaaagcgcataacagcggtcacgaagtgttgattcatctcccgatggcaccgttgagtaaacagccgctggagaaaaatacgctacgcccggagatgagcagcgacgaaattgagcgcattattcgtagtgcggtcaataacgtgccctatgccgtggggatcaacaaccacatgggcagcaagatgacctctaacctgtttggtatgcagaaagtgatgcaggcactggagcgttacaatctttacttcctcgacagcgtaaccatcggtaatacccaggcgatgcgcgccgcgcaaggtactggcgtgaaggtgatcaaacggaaggtgttcctcgacgattcgcagaacgaagcggacatccgtgtgcaatttaatcgcgcaattgatctggcgcgtcgcaacggttcaaccattgccattgggcatcctcacccttcaacggtacgcgtgctacaacagatggtttataacctgccgccagacattacgctggtgaaagccagcagcttgctgaatgaaccgcaggttgatacttctacaccgccgaaaaacgctgtgcctgatgcaccgcgtaatccgttccgtggcgtgaagctgtgcaaaccgaagaaaccgatagaacctgtttatgctaatcgcttctttgaagtattaagcgaaagcatcagccagagcacgctgatcgtttacttccagcatcagtggcaaggctggggcaaacagcccgaagcggcgaagtttaacgctagcgcaaattaaaggcgctacgcgtaatgcgatggtgcgaccgcgttttgtcgcgccattgccataagcggaaagaccacagtaacgcctggtaaccgaccttcacgctgcgcacattggtaatcaggcgcttatacataccggaagtaaatatctcggcaatcatccgttggcgggtaagaatatccggctctttgcgcaccgcatggcaaacacgcaatgcctcgtaagttatttgctgatgaaattccggataaatcataattttgtcggcataatttcgatttaatttctccagcaggcgggtaatcttaatatagtgacgttgataattaaggtttttattcccttgtctatgcaaccgactcactgacgtattatgcagataatatttatataatgattgctcggtatatcgcgcacgcagcgcgttaaacatgaattctgttgtccagacaatatcctgatgatgtaatccggcaataaatttaatgttatttttaacaataacatcacggcgataaacccccatccagacaacgtgagtccaacggcgcgaagaaagccccatccgcagccagtccgggccggttaagacgccggttgagcgaaggcgatcggtggggatggattgccaggtttctcccgtttcacgaaaacaccagtcagcgttgcactgcgccacgtcgaggtcgtcctctaacgccatggtcatcagcgtttcgtacatggtgggatagacttcatcgtcagcatcgacaaaagcgacatatttgcccgttgccacttcaatcccacgattacgcgccaccgatgcgccagcattcgcctgatgcaacaaacgaacgtgcggattgttttctgcgtaatactttgctatttcaacagaattatccgttgaaccatcgttaataataatgatttccagagcagtccaggtttgcgtaattaaagattccatacaagtgcggaaatcatcgcccgcattatataacggaataataacactaagtttattggtgctgttcatcataaattaccgacgacctctgaagttatcctgacgttttacaggctttgtattaagaaactattaagcctgtgagatattatttttacaggtgagagagtcacttcagggtagagagataatgagagcagctatataagagatcagcacaattacgaactctttattacactgacaggattttacatatttaacagattatcctcagataaaagggctggaataccagcccttgttcgtgttaatcccagctcagaataactttcccggactggcccgaacgcatagcgtcaaagcccttctggaaatcatcgatagagaaacgatgggtaatgatcggcgaaagatcgaggccagactgaatcagcgccgccatcttgtaccaggtttcaaacatctcacgaccgtaaatacctttaatgaacaagcctttaaagatcactttggtccagtcgatagacatatcagacggcggaatacccagcatcgcaatacggccgccgtggttcatggtgtcaagcatggtacgaaacgctggcggcgcaccggacatttccagaccgacatcaaaaccttcggtcatgcctaactccgccatcacgtcattgagattttctttggcgacgttaaccgcacgggtgatacccattttacgcgccagctcaaggcggtattcgttaacatcagtgatcaccacattgcgtgcaccaacgtgtttcgccaccgccgctgccataataccaatcgggcctgcaccagaaaccagcacatcctcgccaaccagatcgaacgacagcgcggtatgcacggcattaccgaagggatcaaaaatggaagccaggtcgtcggagatattgtcgggaattttgaaggcgttgaacgccggaatcaccagatattcggcgaagcagcccgggcggttaacgccgacgccgatcgtgttgcggcacagatgggtacgaccgccacgacagttgcgacagtgaccgcaggtgatatggccttcgccagaaacgcgatcgccaatcttgaagcccttcacttcctgaccaatacctaccacttcaccgacatattcatggcccacgaccatcggcaccgggatggttttttgcgaccactcatcccagttatagatgtgaacgtcagtcccgcagatggctgttttacggattttaatcagcagatcgttatgcccgagttccggtacaggaacgtcggtcatccagatgccctcttccgctttcagtttggataacgctttcatctcacatcctcaggcgataacgcccagttgtttaccaatacgcgtgaatgcttctactgcacgcgtaatttgctcaggggtatgcgccgccgacatctgggtacgaatacgcgcctgacctttcggaacgaccggatagaagaaaccggtgacgtaaatgccctctttttgcagctcacgggcaaatttctgcgccactaccgcatcaccaagcatgaccggaataatggcgtgatcggctcccgccagggtaaagcccgccgccgacatttgcccacggaactgacgcgcgttcgcccacagacggtcacgcaactcgctacccgcttcaaccatctccagcactttgatggaagcggcgacaatcgctggtgccagcgagttggagaacaggtacggacgagaacgctggcgcagccactcaaccacttctttgcgcgccgcggtataaccaccagaagccccgcccagcgctttaccgagcgtgccggtgatgatgtcgacacgccccatcacatcgcagtattcatgggaaccacgaccattttcaccgacaaaaccgaccgcgtgggagtcgtctaccatcaccagggcatcgtatttatctgccagatcgcaaacgcccttcagattggcaatcacgccgtccatcgagaacacaccatcggtggcaatcagcacatgacgcgcaccggcttcacgcgcttctttcagacgagcttcaagctcctgcatatcgttgttggcatagcgatagcgtttagctttacacagacgcacaccatcaataatagacgcgtggttcagtgcgtcggagataatggcgtcttccgcgcccagcagcgtttcaaacaggccaccgttagcatcaaagcaggaagagtagagaatcgcatcttccatccccaggaatgccgccagtttttgttcaagctctttatggctgtcctgagtgccgcaaataaaacgcaccgaagccatgccgaaaccgtgagaatccattcccgcctttgctgccgcaatcagatccggatgattcgccagcccgagatagttgttggcacaaaagttaatgacgtggcttccatcagccacggtgatatctgcttgctgcgcagacgtaataatgcgctcttctttaaacaacccttccgcccgtgcggtttccagatcgttggttaactgctgataaaattctccacgcattgcgattctccagacagggcaaattccagcacatattacccaaacttataggtcgcgacgagataacgcgttaacacttctgcaaaattcaggataaataacgtccatcaatctcacttttggcgaatggctgaagccaacgccgtgtagtgatatgatagaagtattcgtgtctgagattgtctctgactccataattcgaaggttacagttatgatcatcgttaccggcggcgcgggctttatcggcagcaacatcgttaaggccctgaatgataaaggcatcaccgatattctggtggtggacaacctgaaagacggcaccaagtttgtgaacctggtggatctggatatcgcggactatatggataaggaagacttcctgatccagattatggctggcgaagagttcggcgatgtcgaagcgattttccacgaaggcgcatgctcttccaccaccgagtgggacggcaagtatatgatggataacaactatcaatactccaaggagctgctgcactactgcctggagcgcgaaatcccgttcctgtacgcttcttccgcagccacctacggcggacgcacctccgactttattgaatcccgcgagtacgaaaaaccgttgaacgtctacggttactcaaaattcctgtttgatgaatatgttcgccaaatcctgcctgaagcgaactcgcagattgttggcttccgctatttcaacgtttatggaccgcgtgaaggccataaaggcagcatggcgagcgtcgctttccatctcaacactcagcttaacaaaggtgaatcaccgaagctgtttgaaggtagcgagaacttcaaacgtgacttcgtctatgtgggcgacgtggcagatgtaaacctgtggttcctggaaaatggcgtttccggtatcttcaacctcggtactggtcgtgcggaatccttccaggccgtagcagatgctactctggcttatcacaagaaaggccagatcgaatacattccgttcccggataagctgaaaggccgctaccaggcgttcactcaggcagatctgacaaatctgcgcgcggcgggttacgacaaaccgttcaaaaccgttgctgaaggtgtaatggaatacatggcctggctgaatcgcgacgcataagagctctgcatgaaaatactggtgatcggcccgtcttgggttggcgacatgatgatgtcgcaaagtctctatcgcacgctccaggcgcgctatccccaggcgataatcgatgtgatggcaccggcatggtgccgtccattattatcgcggatgccggaagttaacgaagctatccctatgcctctcggtcacggagcgctggaaatcggcgaacgccgcaaactgggtcatagcctgcgtgaaaagcgctacgaccgcgcctacgtcttaccaaactccttcaaatctgcattagtgcctttcttcgcgggtattcctcatcgcactggctggcgcggcgagatgcgctacggtttactcaacgatgtacgcgtgctcgataaagaagcctggccgctaatggtggaacgctatgtcgcgctggcctatgacaaaggcattatgcgtaccgcacaagatctgccgcagccattgttatggccgcagttgcaggtgagcgaaggtgaaaaatcatatacctgtaatcaattttcgctttcatcagaacgtccgatgattggcttttgcccgggtgcggagtttggtccggcaaaacgctggccacactaccactatgcggagctggcaaagcagctgattgatgaaggttatcaggtggttctgtttggctctgcgaaagatcatgaagcgggcaatgagattcttgccgctttgaataccgagcagcaggcatggtgtcggaacctggcgggggaaacacagcttgatcaagcggttatcctgattgcagcctgtaaagccattgtcactaacgattctggcctaatgcacgttgcggcggcgctcaatcgtccgctggttgccctgtatggtccgagtagcccggacttcacaccgccgctatcccataaagcgcgcgtgatccgtctgattaccggctatcacaaagtgcgtaaaggtgacgctgcggagggttatcaccagagcttgatcgacattactccccagcgcgtactggaagaactcaacgcgctattgttacaagaggaagcctgacggatgcgggttttgatcgttaaaacatcgtcgatgggcgatgttctccatacgttgcccgcactcactgatgcccagcaggcaatcccagggattaagtttgactgggtggtggaagaagggttcgcacagattccttcctggcacgctgccgttgagcgagttattcctgtggcaatacgtcgctggcgtaaagcctggttctcggcccccataaaagctgaacgcaaagcgtttcgtgaagcgctacaagcagagaactatgacgcagttatcgatgctcaggggctggtaaaaagcgcggcgctggtgacgcgtctggcgcatggcgtaaagcatggattggactggcaaaccgctcgcgaaccgttagccagcctgttttacaatcgtaagcatcatattgcaaaacagcagcacgccgtagaacgcacccgcgaactgtttgccaaaagtctgggctatagcaaaccgcaaacccagggcgattatgctattgcacagcatttcctgacgaacctgcctacagatgctggcgaatatgccgtatttcttcatgcgacgacccgtgatgataaacactggccggaagaacactggcgagaattgattggtttactggctgattcaggaatacggattaaacttccgtggggcgcgccgcatgaggaagaacgggcgaaacgactggcggaaggatttgcttatgttgaagtattgccgaagatgagtctggaaggcgttgcccgcgtgctggccggggctaaatttgtagtgtcagtggatacggggttaagccatttaacagcggcactggatagacccaatatcacggtttatggacctaccgatccgggattaattggtgggtatgggaagaatcagatggtttgtagggctccggggaatgagttgtctcaattgacagcaaatgctgttaagcggttcattgaagaaaacgctgccatgatttaaattacaactctttaatagataattttgaaataaaatcagcttccttgctgattttatttcacatattcattacttctctaataaacattggtccgattgtgctttaaaataagcacaaagcaatattatggtgataaacacagcagtcggaaccggtttagaaaagagtattacgtcacttagtcctactaccagtagtgaaaaaagcaagattaaaatataaggttctttagcagttcttaaggcatatatgagtattgctgaaaatgctaaaattgttaatacaactccaggaataccacgcgttgataacgtatctatgagatcgttatgcaaatgagaatctacatagggtaaagcgccactcaatctaggctctttttcttctagttcatgtattttttccgcacgtttttccagtgattgtcctattggagaatatgtttttaagccaacttcatacattgccagacgggcaccgactgaagttctggtgttatcatgcgaataattaactaaatcgttatttaagtcattcattctcataagcaatgtatctttaaaagaaaatacacctgctaataatgcaatcgtaataaaacaatataacttataattaattcgcttattaatataactatccattacgattaatattaacgcaaagaatggaaacactaatatggctgcacgcgtctcagttactatgacagcacataagctaagcatgaagttaattgtatataatgttgttttatgtctaaagtcggattttaaaatgagaattgatgccagtaaagaaggaaaaaggatgatgtagcctgctgttgtagcgtgggaagctgataatgcaacacggtcgacgtttaaatagaaatgttgccacatggcatgcgcaaaaaaaagtaactgcgttgccagggatgcgaacagaattagtttcccaaattttatttttgttctcatctcatttttagcaaaaagaactaagaaaataaaagcgctacacaaggcaatttttccagtttccattgggccacgatatgcattggtataaacagagcctgaaattttataatgtgaataccagatgatatttacgatacccaaaagacataatgagatgaaaattaacaaagtaggattattagttattgttttttttggtgtcacaagaaaatacaatgcagatataattccagctgcatgaagaaactttgttgcaacatcatcccataaagacaaagtcattaaagaaaaaatacataatatgagaattaaagactttataccagaattaatttcattccaacaaaacgacatatagtttcaacctatgctacgaggatgggttatttaatgcaagatctaacgtttattcttttttctatttaccagtcttaccatcctccagataatataattttttgatgctaatatttttgctcgtctcttatctctcttgccaggaagattacaatcttttaattctttttcattgctttcaactaattgattcaattgtttaaaatcaccattaagtagaacattccacaaataacgagttttatgataagctctattttgactcaataatgtatgaatttcttctttccggttacctttgtataactgcatcacagaagagtagattttttcgtgcgcaaatgactcatgtcgataatgagtgatggttctacatgagttcattaaggaattttctctatagttatgcttatacatataatatggaaccgcatacatatcgcatgtaattagcagtcgatagataaaatccagatcttctcctagtcgtaaatcttcatcaaaaaaaagattattctcttccagaagttgttttcttataaacaagcaccctatatggaatctaacctttttataaaaaaagtcgaaaagtaaagatccttcattaaactctgtatttataggtgagtaagtaacaccattttttatatgatggccataaagcccacaataaatggcatctcctcccgtctcatgttgtctggaatacatcttcagcagatagttaggatctatctcatcatcatcatccataaaacatataaactgtccttgcgccttgcggatacctgtattcctggcagacgaaacaccgccattttctttattgataataattaatcgagagtgggttaacccatactctctcaaaacgtttgatgtgttgtctttagaaccatcattaacaataacaatttcaaaatttgggtaagtttgtttttctaatttcgttagagtttcagtaatgtaatcagatgaattatacgtcggtattattatggatactaaagggtaatcattgctcatcgtgttctcttgcctgaactaataaaatatgatagtactcatccttaattattattgtaactcagacatccatgatttttattattacccaaatagttttcttttatacttatttaatttaaatttaatgaagtaaataaaagcgttaaacgtatcaccatttttctttgcatgttgatatttcacttgatactgcttttcattcgtggctggaataaacgccacatcattccagcaagaagcctgataagcctcattaaaatagttctggcagggataattcgtccagtcgttccagggcttcgttacgccaacataatgaatcagcttagtatcatcggtaatggtctttttataatcttcatcgcttttattttttaactcataatcgatgccataaaagcaatcataatcgccgctaataaaaatacaatgaccaaaaaacagaatatttaaaatatcctgatcaaggcatttatacttcgtgtgctgcgggtcacttgccagcatagcaatggctttattcataaaatcatttttcgcccatgcttcaagctgcagatatactacaccggcgttgaaataattccctggaagtccctctatagccagacgcttcgctggtttttcctgcataaaaggcacatctttaataacagctgcaaacttatccccatcaaaattaatatcaagcaatccagctaatgagcctttacagatgacatcagcatcgatatataacagattttcaatagtttcactcagatactggaacgcaactaaacggaagaatgttgcataagaccactgtttcaggctggggaagatatcaataaaggcattggagactttataaattcttacttcaacgttagcatttttgctggtaaaagcattaacacgttgtagataatcttcatcaatgtagtcggtaaagagatgaaacttaaccgcaaggtccgggttatgcataacaactgattgcatagatactgccgcaccaaataaaaagttacggtcaataccgtaagcgatatttaacacacgatcggtgttagcaatttccccagagacagcgacttcagtaatactctcagctaataaatccatgttggttccgttttgactgtgtggtttacgctttgccttttaattttttaataaatttgcgtagtttggttctgtagattactgaatggtagccataatcttttatttcgttggcaatacccaggtgacgttccatggccagacgatcacgagctttacgctctgccgtacagcttttaccggataggtcaattatcctgacaccatctttactaacgataaaattaccccggtgtgggtcgcccgatagcatatttaaggcatgcaatttttccattgaagccttaatttctgctttaacattttctggaataatcggcatatcattgagctctacgccctcgacatactcgataagcatgataaaaacactggcatagttgaaaattttacgctcagccagaaaataaaaatcattaggaaaagtaagacctgcacttctgacacgatcggtttcaacgatcaaattctgatagtagtcaccttttacaaaagattttaaaaaacgttcattccttttcgttttcggagcaaagactttaaaaacatagcgaccatatttcgtatcaatcaacgatactttggtatcatcaatattacgtaatacttttactgttttaaaattataggccagtatttcatcaaagatttctttatatttattatcgttatctttgtaataaaatgagaagccgcgatagcgtatacttgtaatcataagagtaatttatttcttaagcttgtacttaattaatgaagttatacctttaatatactcaccatgggcaaacagatgcttatattgtttctgcatttctgcaacagtccgcgcctctttaagaggatatttcttccagggagattgttcacgcgcgatattaaagtatgatgcagacggatatccagcccagctatgccatggtttagttatccctgtatagtgaatcaatactgttttatcagtaatggtttgctgatactttcgatgactacgatcatgaagttcgtttttcagggtataaatagtatcaaaatccttcgcgaggtagatattattcatattaaatgcgatattcaacgcatcctgatctaaatatttaagagagccatatttagtttcccctcgtaaaagcgtgagtaaatacggtgtcaaatttgcttcatgccattttttaagattgacatagataacgcctgcattgaaataacgtccattcatttcgggaatgttgaggcgttttgcacatgccgcctgagtactatcattgtcaggaatgaccgcagcaaactcatctttaaatataatttctgtgagaggtttcaggcttcctttacaaacaacatcggcatccagatacagcagtgtggaaatactttcactcagatattcaaaagacaataccctgaagtatgtcgcgtacgaccaaaactgtgacgtcggcagatcagcaaagtatttggggtcaattaaatatacaataattgaggtattaaattgttttgctgtttcattaaatgactttaaataattatcatccacataatcagtgaaaacatgaaagacaaaattaatatctgaattattaatcaaaacggaagaaattgaaacgccagcaccatacaaaaaattcttatcgataccgtaggaaacatttagctctggggcgttttcttttttattatctgctaaatacgaaaaccgttcttttataaattcattcatttaacttttctcaatttcattttattatctttaaataaaaataataaatataattcattatcccgttaattggtttattttgtttaaaattatgcttggcgcaataacgagcatagtttgagttaactggccgcattaacggttcatttttccagggcgatgcttctttggctttgataaatggttgcgcacttggataactggcccagtaatgccagggttttgtcgggccgacataatgaattaatacgatttcatcattaattggacaaacaaatgatttttttaattcataatttaaactaaactgcgtattgtatttagcatcaatgaatttaactttccctaacaggataagattaaggatatcttgatccatataggttaaatgggaaacgatggctttatcagcaagcatcgacatcgctttagcagaaacggactcctgcgcccacgctagtgtattaattaacaggacacctgaattaaagtaacccttttcaagttcattacactgcagactttgaccccgtaacgaccaccagttagcatcgcgttcagtaacaacagcagcaacgttattggcaagatccattgttatcagcggctttaagtttccctgacaggcgatatcagcatccaggtaaaggatcttatcttgttgatcaataaagtaatctgcaattacaaaacggaaatacatggcaatagaccaatttttggtcgtcggtaatgccttaagccgttcacaatttaccagatggatctggatacaggtacgatagcttttcgccaattgggctaaacgctggatatcggcttcagggatatcatcaataaaaacgtggaaaacaaaactcacgtcgttgttatgtaacaaaactgacgtgattgaaacaccacaaccaaaaagaaagtttttatcaatgccataagcaacatggaatgatgatgccactgacgccgctggcctttcatcgaagatgattgtcttattgatcatctcttgtggattaaaatagtgggcactcatatttctctccggaaattacaacgattttcgaatcgttctttccctgatttttgtggcttttgcttctgcttgcgacagcagtccttgttcctgcttgagaatgtctttaagcggggcggcaaaatacactttcataaaccgccagatatcccgctgagtcaggccgatattcatcgaagaaaaataaagcccaataagatctttatcgcgccaacgacgtggaacgcgcgtgcgaagctgcgcccggtgcaggtcaattaccgaaatttttaactcctcttccttaccggaaaaaggcaagtgcagcaggaaatgacagatataacagtcacggtgattaatgcccgcagcatgcatatcgcgcaccatcgtcgcgacacgcttaataagcatacgctttacgcgaacatctggtgggttggtcgcccagtcagcacagtaatcttccagacttatggttggtgtcagatcttcggtaataataaacgaggttctggtcagcggattcatgcctttttcgccgaatgccaccccatacatagtatcaacgccgacatcccgcagtcgatgaatcgcattccattcgcggtctgcgcctaatactggcatccgcaatgagagtaaatttttgattatctctttcagggtcgtgccgcgatgccatttgagaaaatagctttttcccgccatttcaaagcgcagagtacggcgagtttccagttcacgaaatatctcaccctgcaaggttttaacttcctcaaaaggatctttaccgcgccataacgtggcaaacggctctttaagttcaaccatccagaccacccgttatgatatccgccgctttctctggcagactgtataaatcttgtgtatcagcataatgtcgcgcattttccgcccaggcctggcgcaatgaagattgcgttaacgctttgcgtaaaatctcattcaatgtttcctggcggaatggctcagcaatagcctcgccgcaattggcctcgacaatataaggcgcatagccacaaacggctgttgttagtaccggtaatcctgcagtaatcgcttccagcagcacaattcccgccgcttcctggtaggcaggatgcagtaataaatccgccgccgccattaattccgagacatcattgcgccccgagaagaagtgaacattactgcgcacgccgcgtttttctgccagcgcctcaaattttcgcggtttatcctgcccaacaacatatagcaatgtgttgtggcgcagcgaatccggtaaagaagcaagtgcttcaatggaacgatcgacacctttacgcgtgaagtctgaaccgacctgcaacaataaatattgttgttcggttattccattcttcttacggaagatttcacggctattggctggctgctggctatatttacgatcaggataaatccccggtggcagaatatgaaaacgctccgcttcagtctgataatgtttctggaaatcggcgatttgcttatctgtcagcatcagcagctgtgtcggcttgccctgttcgaaggttgcccgctcaaaggcggcataatggcgataacgtgacgtcaggcgatagaaaaagcctttctcctgcgctactttctcggcataacaaacatcagcggcataataaacgtccagccccggcattttgttgaatccaacgactttatcgacgggatgttcgcgtaaatgtttttgcacccaggtaaaatactccgcattgcgcccgtgattggtatgcgatttaaccggcactttgatcagttcaaatacatcagggcattcgccttcccacgactgggtataaacccgaacatgatgacctcgggcggtgactgtctgagcaatacgcataaaatcgcgctgcaaaccgccaaagggaaaatatttatataaacaaaaagcaacgatcataacgacgtacctgtcgtggaggagggcagtaatttatcgacagcagcaatgacatctgccgccggaataaccgaaagatacatctcatttcggtcacgctgatcgcgcgttggcatttcccggtaatctcccgcccagaattgaatcatgttatttgaccagggacgccagaaaatatggtctgtcgcaccaaacagcgatatcagcggcgtattaactgcagcggcaatatgcgccggtgcggaatcaacgccaataaacagctgcgcatgatcgattaacgcaccaagttccgggaaggtcacctttccagccagcgccgttactggtggcgtctggcatccctgcgcaatttcattgacgcaggccagatcgtctttatccgggccggacgtcagaacgacttcataaccacgagcatgtaaggcatcaatcacagcggaaaacttggcgttgtcccagcatttgaagatttgccgcgccgtaggttggataaccacataattttgtccaacaccagcgtgatcaagttcgcgacgcatacgtttccagcttgcaggcgggtaactcatggttgtctgcttcaccaacgaatcaagtcccaatggtgtcagcacggataagttactttccaccacatttccaccctgcaacggcaccaaatgggtgaaacttttacgccaaaaagcagactgccgatgatgataatcctgggaaattttcacacgagcatttaataagcgaaccagtatagcaaccatccattgatcggtaagattgacgataaggtcatacttattggcacgtaataccttgatgagatgaaaaaagttggcaattttttctgaggcttttgcttttttattttttatgccgtagagcgcgttaatctctggattttcagacaggatcgggatggtgtcctgataaagcagcacatcgatttttgcgtcagggtaattttttttcagcgaactaatgacgggagtagttaataacatatccccatgaaaacgcatcttaatgagcaaaattcttcgaaatggcttatccacaagtaactctttttgttgagattatccgattaaggtgaagcagaaaaagcacgctaccgccccaggctcaacagctacctgaatactgataccgcactgatattgacgcgctagtgtatcacttctttcgcggcaatccgacccgaatgatttttaagcacattgttgattttcaataaagaaatcaatcaaataaaatcattagcaaccatattctttcactgttgctctgcgattccttcctgcacgtacagcagaaatcaatgaatcgcataaaaatacaaaaaaagtatagatgttcagcaagaattggcgggtaaattgctatttaagtcaaaaacgggaaaagtaatggtaaagccacagctaaatacatagaatccccagcacatccataagtcagctatttactatgctcgaattgctttacaccgcccttctctaccttattcagccgctgatctggatacggctctgggtgcgcggacgtaaggctccggcctatcgaaaacgctggggtgaacgttacggtttttaccgccatccgctaaaaccaggcggcattatgctgcactccgtctccgtcggtgaaactctggcggcaatcccgttggtgcgcgcgctgcgtcatcgttatcctgatttaccgattaccgtaacaaccatgacgccaaccggttcggagcgcgtacaatcggctttcgggaaggatgttcagcacgtttatctgccgtatgatctgcccgatgcactcaaccgtttcctgaataaagtcgaccctaaactggtgttgattatggaaaccgaactatggcctaacctgattgcggcgctacataaacgtaaaattccgctggtgatcgctaacgcgcgactctctgcccgctcggccgcaggttatgccaaactgggtaaattcgtccgtcgcttgctgcgtcgtattacgctgattgctgcgcaaaatgaagaagatggtgcacgttttgtggcgctgggcgcaaaaaataatcaggtgaccgttaccggtagcctgaaattcgatatttctgtaacgccgcagttggctgctaaagccgtgacgctgcgccgccagtgggcaccacaccgcccggtatggattgccaccagcactcacgaaggcgaagagagtgtggtgatcgccgcacatcaggcattgttacagcaattcccgaatttattgctcatcctggtaccccgtcatccggaacgcttcccggatgcgattaaccttgtccgccaggctggactaagctatatcacacgctcttcaggggaagtcccctccaccagcacgcaggttgtggttggcgatacgatgggcgagttgatgttactgtatggcattgccgatctcgcctttgttggcggttcactggttgaacgtggtgggcataatccgctggaagctgccgcacacgctattccggtattgatggggccgcatacttttaactttaaagacatttgcgcgcggctggagcaggcaagcgggctgattaccgttaccgatgccactacgcttgcaaaagaggtttcctctttactcaccgacgccgattaccgtagtttctatggccgtcatgccgttgaagtactgtatcaaaaccagggcgcgctacagcgtctgcttcaactgctggaaccttacctgccaccgaaaacgcattgaggttgttatgcaaaaacgggcgatttatccgggtactttcgatcccattaccaatggtcatatcgatatcgtgacgcgcgccacgcagatgttcgatcacgttattctggcgattgccgccagccccagtaaaaaaccgatgtttaccctggaagagcgtgtggcactggcacagcaggcaaccgcgcatctggggaacgtggaagtggtcgggtttagtgatttgatggcgaacttcgcccgtaatcaacacgctacggtgctgattcgtggcctgcgtgcggtggcagattttgaatatgaaatgcagctggcgcatatgaatcgccacttaatgccggaactggaaagtgtgtttctgatgccgtcgaaagagtggtcgtttatctcttcatcgttggtgaaagaggtggcgcgccatcagggcgatgtcacccatttcctgccggagaatgtccatcaggcgctgatggcgaagttagcgtagcgtttatgccggatggtatgccatccggcgcgcatgaattacttctggcactgccgacaataaaacgttgcccgctgcgcatgtttagtcgccacaatcggcgtaccgcacacccgacacggctcaccttttcgcccgtaaacctgcaattcctgagcgaaatagcccggtttaccatcactttgcagaaaatctttcagcgttgtaccaccctgctcaatcgaacgcagcaacaccgctttaatcacccgagctaacaattcacactctgccagcgacagtgatgacgccagccgatccggatggatccccgccgcaaacagtgattcgctggcatagatattccctacccctaccaccagcttgttatccatcagccacggtttaatcgccgtttttttcttcgcgcacttctgatgcagatactcaccattgaaatcgtcgctaagcggctccggtccaagatgggtcagcacattatgcccttccagctctttggtccacagccaggcaccaaagcggcgcggatcggtgtagcgcagcactttgccgttgctcatcaccaaatccacatggtcatgcttttcagggggaagttcttctggaaggatgcgcaggctgccagacatccccaaatgaatgataatccagccctcaggcagctccagcagcaaatatttagcccgccgctgcacgctaagcactggttggtcgcttaaacggtagatctcttctgaaaccggccagcgcaagcgtccgttgcgcaccactgcatgaagaatggttgcaccaacgagatgcggttctatgccgcgacggctggtttcaacttcgggtaattcaggcatagcatctccaggaatgaacagatgcaatcaatatgggggcaagcagataacaaaaaaccccgccggagcgaggttttttgttacatcaaagcgagaattatttgattttcgcttctttgtagatcacgtgctgacgaacaactggatcgaattttttcagttccagtttttccggcttagtacgtttgttcttcgtagtggtatagaagtgaccagtaccagcagaagaaaccagcttgattttctcacgaatacctttagccatgatttatttcctctaagtacttagtacttttcgccacgggcacgcagttcagccagaactgtatcgatgccttttttatcgattacacgcatacctttagcagatacgcgcagggtgacaaaacgcttctcgctctcaacccagaaacggtgagagtgcaggttcggcaggaaacggcgtttagtcgcgttcagtgcgtgggaacggttgttaccggtcaccggacgcttgccagtaacttggcagactcgggacatgtctattctccaaaaatcaaattagctcgagcttcgtatggggtattggcgcctcgtcaggctttacagcccggtcatcgcagttctatgtgaactctcgattgccaggcccaaatgccaaacccgagattctcaaaggtggcgtagtatacgctgactcagcgatgtgctcaagtcccgaacagacaaagatcccgaaggatcgcgcatagcgggttaaatccagccgcgttcggcaaaagaaacatactctccacgcccaatcacgatatggtcgagcacgcgtaaatccatgaactgacaactctttattatccgttcagtaatgagtttatccgctttactgggttcagcacaacccgaagggtgattatgtgcaaggatcagcgccgaggcgtttatttttatcgcttcgcggataatttcccgaggatggacttcaacatggtttagcgtgccggaaaaaagacggctatgcgttataacccggtgttgtgagtcgagaaagatcaccataaagatctcccgctcctcacccgtgagctggctttgtaaaaattcccgcgtcatctccgggctgagtaaagggcttttttcacgcatccgcacgttgtagtaacgccgcgccagttcagcaatcccctttaactgggcaaatttcgctacgccaattccatgaacgccactaaattgttcatattcagaggttaacaagccataaagagagccgaaattctccagcatctcttttgccagggttaatacatctttaccgcgcgttccggtacgcagaaataacgccagcagctcgacatccgttaaggcgctaataccaaacttcagcattttttcgcgcggcatcaacagctgtgcattgtttttcaccttcacctcctttgtggtgctcgcagcctgtcatagccgttccgttaaatcgacggccagttttcaatcctggaaagcgcctcgcaaagtgaatctcaggtgaaggcacgacaacaaaagtattgtgataaaatcgccaacttctggtgtcaccctacaggaaaaatcaacatgagcctggccggtaaaaaaatcgttctcggcgttagcggcggtattgctgcctataaaacccctgaactggtgcgtcgtttgcgcgatcgcggggccgacgtccgcgtagccatgaccgaagcggcaaaagcctttatcaccccacttagcttgcaggcggtttctggttatcccgtttccgacagtttgctggacccggcagccgaagccgctatgggccatattgagctgggtaaatgggctgatttagtgattctcgcccctgccacggcagatttgattgcccgtgttgctgccggaatggcgaatgacctggtatcgacgatttgtctggctacacctgcgcctgtagccgtgctccccgccatgaaccagcagatgtaccgtgccgctgccacgcagcataatttagaggtgcttgcttcccgtggtttgctcatctgggggccagacagtggcagtcaggcttgtggtgatatcggtcctgggcgaatgctcgatccgttaaccattgtggatatggcggtggcgcatttttcgcccgtcaacgacctgaaacatctgaacattatgattaccgccggtccgacgcgtgaaccgctcgatccggtgcgttatatctctaatcacagctccggcaagatgggttttgctatcgccgccgccgctgcccgtcgtggcgcgaacgtcacgctggtatcaggtccagtttcactaccgacgccaccgtttgttaaacgtgttgatgtgatgaccgcgctggaaatggaagccgccgtgaatgcttctgtacagcagcaaaatatttttatcggttgcgccgccgtggcggattatcgcgcagctaccgtggccccagaaaaaatcaaaaagcaggccacgcagggtgatgaattaacaataaaaatggttaaaaaccccgatatcgtcgcaggcgttgccgcactaaaagaccatcgaccctacgtcgttggatttgccgccgaaacaaataatgtggaagaatacgcccggcaaaaacgtatccgtaaaaaccttgatctgatctgcgcgaacgatgtttcccagccaactcaaggatttaacagcgacaacaacgcattacaccttttctggcaggacggagataaagtcttaccgcttgagcgcaaagagctccttggccaattattactcgacgagatcgtgacccgttatgatgaaaaaaatcgacgttaagattctggacccgcgcgttgggaaggaatttccgctcccgacttatgccacctctggctctgccggacttgacctgcgtgcctgtctcgacgacgccgtagaactggctccgggtgacactacgctggttccgaccgggctggcgattcatattgccgatccttcactggcggcaatgatgctgccgcgctccggattgggacataagcacggtatcgtgcttggtaacctggtaggattgatcgattctgactatcagggccagttgatgatttccgtttggaaccgtggtcaggacagcttcaccattcaacctggcgaacgcatcgcccagatgatttttgttccggtagtacaggctgaatttaatctggtggaagatttcgacgccaccgaccgcggtgaaggcggctttggtcactctggtcgtcagtaacacatacgcatccgaataacgtcataacatagccgcaaacatttcgtttgcggtcatagcgtgggtgccgcctggcaagtgcttattttcaggggtattttgtaacatggcagaaaaacaaactgcgaaaaggaaccgtcgcgaggaaatacttcagtctctggcgctgatgctggaatccagcgatggaagccaacgtatcacgacggcaaaactggccgcctctgtcggcgtttccgaagcggcactgtatcgccacttccccagtaagacccgcatgttcgatagcctgattgagtttatcgaagatagcctgattactcgcatcaacctgattctgaaagatgagaaagacaccacagcgcgcctgcgtctgattgtgttgctgcttctcggttttggtgagcgtaatcctggcctgacccgcatcctcactggtcatgcgctgatgtttgaacaggatcgcctgcaagggcgtatcaaccagctgttcgagcgtattgaagcgcagctgcgtcaggtattgcgtgaaaagagaatgcgtgagggtgaaggttacaccaccgatgaaaccctgctggcaagccagatcctggccttctgtgaaggtatgctgtcacgttttgtccgcagcgaatttaaataccgcccgacggatgattttgacgcccgctggccgctaattgccgcgcagttgcagtaatatgacgccggatgacttttcatccggcgagtttctttaaacgccaaactcttcgcgataggccttaaccgccgccagatgttccgccatttccggcttctcttccagataggcaatcagatctttcagggtgatgatagagatcactttgcagttgtaatcacgctcaacttcctgaatcgccgaaatctcgccgcgcccccgttcctgacgatcaagcgaaatcaatacgccagcaagcgtcgcgccattagcctgaataatctccatcgattcgcgaatcgccgttccggcggtgatcacatcatctaccagcattacgcgtccttgtaacgcgctaccaaccagattgccgccttcaccgtggtcttttgcctctttgcggttaaagcagtacggcaggtcaaggtcatgatgctccgccagcgccacggcggtagtggtcgcaatcgggatccctttgtaagcagggccaaacagcagatcgaactcaatgccagaatccaccaatgcttcagcgtaaaaacggcctaacagtgccaggtcgcgcccggtattaaacagcccggcgttgaagaaataggggcttttgcgcccggatttcagcgtaaactcgccaaactttaacacctgcttgctaagcgcaaattcaataaactggcgctgatatggtttcatgccttcgctcctcatcttacttttctacagacaaaaaaaaggcgactcatcagtcgccttaaaaatcagtttgccagcgccgccttctgcgtcgctacaatggattcgattccccctcgggccagcgccaacaaggtgagtagctcttcatgggtgaacggctcgccttctgccgtcccctgcacttcaatgatgcgcccgtcttcggtcatcactacgttcatgtcggtctctgcggctgagtcttcaacgtattccagatcgcaaattgcttcaccgtttacaataccgacagaaactgcagctaccatccctttcatcgggttggttttcagcttgccgttttccaccagcttctgtagcgcatctgccagcgccacgcaggcacccgtaatcgacgcggtacgcgtgccaccatcagcctgaagcacgtcgcagtccagcgtaatggtgaactcacccagcgctttcaaatctactgccgcgcgaagagcacgggcgatcagacgctggatttccattgtgcgtccaccctgcttacctttcgccgcttcacgagcgttacgggtgtgggtagaacgtggcagcatgccgtactctgcggtgatccagccctggccctgacctttcaggaagcgcggcacgccttcttcaatagaggcggtacacaacactttggtatcgccaaattcgaccagcaccgagccttctgcatgttttgtatagttacgagtcagggtaacgggacgcacctgattattgctacggcctgctggacgcatattgaaatctccggcttgaaacaaatgtggctgcgcattatacggacttccggcggttattcctatcctgacaaggcatcgatggctataatccttccacctctccttttataaacaggaacgtctatgatccgcagtatgaccgcctacgcccggcgtgaaatcaagggtgaatgggggagcgcaacctgggaaatgcgctcggtaaaccagcgttatctggaaacttactttcgtctgccggagcagttccgtagccttgaacctgtcgttcgcgagcgtattcgttctcgcctgacgcgcggtaaagtggaatgtaccctgcgctatgagccagatgttagcgcacaaggtgagctgatcctcaatgaaaaactggctaaacagctggtaactgccgcgaactgggtaaaaatgcagagtgacgaaggggaaatcaacccggttgatattctgcgctggccgggcgtgatggcagcccaggagcaggatctcgacgccattgccgctgaaattctcgcggcgctggatggtacgctggacgactttattgtcgcgcgcgaaaccgaaggtcaggcactgaaagcattgatcgagcagcgtctggaaggcgtcaccgccgaagtggtcaaagtccgcgcccatatgccggaaatcctgcaatggcagcgtgagcgtctggtcgcgaagctggaagatgctcaggttcagttggaaaacaaccgtctggagcaggagctggttctgctggcacaacgaattgacgttgccgaagaactggaccgcctggaagcgcatgtcaaagagacctacaacattctgaagaaaaaagaagccgttggtcgtcgtctggactttatgatgcaggaattcaaccgcgagtcgaacactcttgcgtcgaagtctatcaatgccgaagtgacaaactccgcgattgagctgaaagtgttgattgagcagatgcgcgagcaaattcagaatattgagtaactcgtaacactaattcttacttttcagccttcacaaatgccgcccactcaaacagagcggcatttttcttccccgcaacttcaattctgttttgcgtgcctgctccagattttgcgatgtttttttgcccagcacactgagaacgtgagatactcacaactgtatataaatacagttacagatttactttctttgcaatcgatatcacatggagtgggcaatgaacgaacatcatcaaccttttgaagaaatacggcattatggcactgaagggcaagaattttggtcagctagagaattggcaccgttactggattatcgggactggcgcaattttcaaaaggtactggcccgcgcgactcaagcgtgcgaagccagcaatcaagctgcatctgaccatttcgttgaaaccaccaaaatggttgtattaggttcaggggctcaacgagaacttgaagatgttcatctctcccgctatgcctgttacctggtagtacaaaacggcgaccctgcgaaaccggttattgcggcagggcaaacttattttgctatccagacccgacggcaggagctggctgacgatgaagctttcaggtaacttcgtgaagacgaaaagcgtctttttctgagaaatgaattgaaagaacataacaaacaattggttgaggcagcacagcaagctggggtagcgacagctactgatttcgccatatttcagaatcatggttaccaagggctgtatggtggattagatcagaaagccatccaccaactgaaggggctgaaaaagagtcagaagatcctggatcatatgggttcaacagaactggcggctaatctctttcgagctacccaaacagaagaaaaactcaagcgggatggcgtgaattcaaaacagcaagctaataccacacactttgacgtgggtagcaaggtgaggcaaaccattcaggaacttggcggaaccatgcctgaggagttgccgaccccgcaggtcagcatcaagcagttggaaaacagtgtaaaaattacagagaagaaatagcagaaactaaaaactctttttgttgattgagacacccgatgcgtaagccaaggtccaggtgcagtgaacacaatggctaaatattgcacctttcttttcccccctcagttttaacctattttttcttatgcattttctcagacaagaagtcagaagaatgcatctctgctacagaaaatagcgatttcacataactacaagttatcaatttcccctcaccttaaaaaatctcaatcgtgacaatgcgcacaaatcgctaccctgccagacagatttttagggagagaaccatgctgttacacattttgtatttggttggcattactgccgaagccatgacgggggcgctggcggccggacgacggcgcatggatacatttggcgtaattattattgcgaccgccaccgcaattggcggagggtcagtgcgcgatattctgctgggccactatccgctcggctgggtcaaacacccggaatatgtgattatcgtcgctaccgccgcagtactcaccactatcgttgctcctgtaatgccttacctgcgcaaagtgtttctggtgctcgatgcgctcggactggtggtcttttctatcatcggggcacaggttgcactggatatggggcacggcccaattattgccgttgtcgcggcggtaaccaccggcgtgtttggcggcgttttgcgcgatatgttctgtaaacgcatcccactggtattccagaaagagttgtatgccggtgtctcatttgcctccgccgtgctgtacatcgcgctgcaacactatgtttctaatcatgatgtggtaattatctccaccctggtattcggcttttttgcccgcttactggcgctacgccttaagctgggattaccggtcttttactacagccacgaaggacactaaggttcaaaacctgtgatctgctgggcagccagccaactgcccagcttcttgatttgcgcattttccttccattcaataacctgtctggcgcgccccgatccagtgcccggcagctgctgccagaactgctccgtgctaaataaaagttgcgaccaggaccgttcatcactggcattaagcgccgcccgggttagcggtattcccattgccatcacccagcgagtaaaaggctgcttacgagccagattaaactgatgccatagctgcgcacttttacttttcgcgatccccggcgtgttctgtaattgctctggcgttaataaaagccaggaaaagatatgctcaaagcgatgagtctgatgcagcgcgcgccagccggcctcaccaatgccatccagcccaagaacctgttttgcccccagccagactaagcgtgaaatgaactgttcctgacaaacatcagaagcaaagtagcaggtcaacgagttaaagcggttttctggcggtgtcggttttgtacgttctgcaccgcgccacaccacatcatcaatgcgaggaataccctgaccggcaaggctgacgagaatctgatcaccaggcgcaatatcccactcctgccagcgcctgacggaaccaatattcacccgctggacttttttatcatccagcatgacaggtgcgagtgacgcaaccaccgatattttaccgctcttacccaccgcaaactgaattgccttcacttcggcaacctgagctacaggttgatatttccaggccaccagccactctgcctggcccggtagccaatggcgggattctggctctttcgccgctcgtacaactacgccatcggtgacgaagggtaattccgctttccaccactcattgcgtacgcgcgcaacttcatcagcatttttcaccgcacgggtatacgtctgcgttagagtaaaacctgcggtagccagctcttttaaacgatcagacattaactgcggtccatccggccatgcccagacaaaaacgcccagagaattcagcgtgtcgctatcgtcctggcgcatcatcaagccagcaacttttgcgcgggcatttattccccccatttgttgttggatatgcccctcgcgctggagaaatatttccccctgaagcgtactgttggctaaaggcccgctaacggtttgcggcacagcggaaattaagctaactttctgcgtccagtcctcgcctttcaggccattaccgcgactgattgctttgttcagtttcccgtcccgataaaccagggttaccgcaacgccatcaacttttggctgcacccaaagatcgctacgttctcgcatccacagacttaatgcgtttttatccaccattttgcgtacacccgtatgggcaaccggatgcataaccgcaccatttaaaggcggcatcatcacgtcgcggggctcgctcccaaagcagcgttgccactgcgtaagacgggcgcttaactgatcgtaaacaccgtcttccacctcactttttccttccttccagtagacatcgtcccactgttttatttgctgttgcaggcgggaaatttcttcctgtgctctggctggcgaccaggccggacagaccgcccacacagatgattgccagcacaagatacttattaatatcgccatccatactttcatcatcacctccgctgtaggtagtcaggcagatatacaacgtgatgaatgcaaagccgagtggcaaaaacggagtctgcgaggacgcttcctgaaaatcgtctttattgcagtgaatgacaggcaaatgcggaagcagctacgcaaaacgcaacaactttgcgcaaaaagtgtgagcaagggctacgtcacatggccgcgccgtgtataataagctcgtatgtaggctttatttcgctaatcacatacgaaagatactcatggctcaaggcacgctttatattgtttctgcccccagtggcgcgggtaaatccagcctgattcaggctttattaaaaacccaaccgttgtatgacacccaggtttctgtttcacacaccacacgccaaccgcgtcctggtgaagtccacggtgaacattatttctttgttaatcatgatgaatttaaagaaatgattagcagagatgcgttcctcgaacacgcagaagtttttggtaattactatggcacttcgcgtgaggccattgagcaagtactggcgaccggtgtcgatgtttttctcgatatcgactggcagggcgcgcagcaaattcgccagaagatgccgcacgcgcggagtatctttattttaccgccgtctaaaattgaactggaccgccgtctacgcggtcgcggtcaggacagcgaagaggtcattgcaaagcgtatggcgcaagctgttgcagaaatgagccattacgccgaatatgattacctgattgtgaatgatgacttcgataccgcgttgaccgatttgaagaccattattcgcgccgaacgtctgcgcatgagccgccaaaagcagcgtcatgacgctttaatcagcaaattgttggcagactgaacctgatttcagtatcatgcccagtcatttcttcacctgtggagctttttaagtatggcacgcgtaactgttcaggacgctgtagagaaaattggtaaccgttttgacctggtactggtcgccgcgcgtcgcgctcgtcagatgcaggtaggcggaaaggatccgctggtaccggaagaaaacgataaaaccactgtaatcgcgctgcgcgaaatcgaagaaggtctgatcaacaaccagatcctcgacgttcgcgaacgccaggaacagcaagagcaggaagccgctgaattacaagccgttaccgctattgctgaaggtcgtcgttaatcacaaagcgggtcgcccttgtatctgtttgaaagcctgaatcaactgattcaaacctacctgccggaagaccaaatcaagcgtctgcggcaggcgtatctcgttgcacgtgatgctcacgaggggcaaacacgttcaagcggtgaaccctatatcacgcacccggtagcggttgcctgcattctggccgagatgaaactcgactatgaaacgctgatggcggcgctgctgcatgacgtgattgaagatactcccgccacctaccaggatatggaacagctttttggtaaaagcgtcgccgagctggtagagggggtgtcgaaacttgataaactcaagttccgcgataagaaagaggcgcaggccgaaaactttcgcaagatgattatggcgatggtgcaggatatccgcgtcatcctcatcaaacttgccgaccgtacccacaacatgcgcacgctgggctcacttcgcccggacaaacgtcgccgcatcgcccgtgaaactctcgaaatttatagcccgctggcgcaccgtttaggtatccaccacattaaaaccgaactcgaagagctgggttttgaggcgctgtatcccaaccgttatcgcgtaatcaaagaagtggtgaaagccgcgcgcggcaaccgtaaagagatgatccagaagattctttctgaaatcgaagggcgtttgcaggaagcgggaataccgtgccgcgtcagtggtcgcgagaagcatctttattcgatttactgcaaaatggtgctcaaagagcagcgttttcactcgatcatggacatctacgctttccgcgtgatcgtcaatgattctgacacctgttatcgcgtgctgggccagatgcacagcctgtacaagccgcgtccgggccgcgtgaaagactatatcgccattccaaaagcgaacggctatcagtctttgcacacctcgatgatcggcccgcacggtgtgccggttgaggtccagatccgtaccgaagatatggaccagatggcggagatgggtgttgccgcgcactgggcttataaagagcacggcgaaaccagtactaccgcacaaatccgcgcccagcgctggatgcaaagcctgctggagctgcaacagagcgccggtagttcgtttgaatttatcgagagcgttaaatccgatctcttcccggatgagatttacgttttcacaccggaagggcgcattgtcgagctgcctgccggtgcaacgcccgtcgacttcgcttatgcagtgcataccgatatcggccatgcctgcgtgggcgcacgcgttgaccgccagccttacccgctgtcgcagccgcttaccagcggtcaaaccgttgaaatcattaccgctccgggcgctcgcccgaatgccgcgtggctgaactttgtcgttagctcgaaagcgcgcgccaaaattcgtcagttgctgaaaaacctcaagcgtgatgattctgtaagcctgggccgtcgtctgctcaaccatgctttgggtggtagccgtaagctgaatgaaatcccgcaggaaaatattcagcgcgagctggatcgcatgaagctggcaacgcttgacgatctgctggcagaaatcggacttggtaacgcaatgagcgtggtggtcgcgaaaaatctgcaacatggggacgcctccattccaccggcaacccaaagccacggacatctgcccattaaaggtgccgatggcgtgctgatcacctttgcgaaatgctgccgccctattcctggcgacccgattatcgcccacgtcagccccggtaaaggtctggtgatccaccatgaatcctgccgtaatatccgtggctaccagaaagagccagagaagtttatggctgtggaatgggataaagagacggcgcaggagttcatcaccgaaatcaaggtggagatgttcaatcatcagggtgcgctggcaaacctgacggcggcaattaacaccacgacttcgaatattcaaagtttgaatacggaagagaaagatggtcgcgtctacagcgcctttattcgtctgaccgctcgtgaccgtgtgcatctggcgaatatcatgcgcaaaatccgcgtgatgccagacgtgattaaagtcacccgaaaccgaaattaatgttttatgaacccaacacgttatgcacgcatctgcgaaatgctcgccaggcggcagcctgatctgaccgtctgcatggagcaggtccacaaacctcataacgtttctgcgattattcgtaccgcagatgccgttggcgtacatgaagttcacgccgtctggcctggtagccgcatgcgcaccatggcttcggcagcggcgggtagtaacagctgggtacaggtgaaaacacaccgcaccattggcgatgccgtcgctcatctcaaaggccagggcatgcagattctggcaacccatctttctgataacgctgtcgatttccgcgaaattgattacactcgcccgacctgcattttgatgggacaggagaaaacgggcatcacgcaggaagcattggccctggcggatcaggacatcatcattccgatgatcggcatggtgcagtcgctgaatgtttccgttgcctcagccctcattctttacgaagcccagcgtcagcggcaaaatgcaggcatgtacctgcgtgaaaacagcatgttgccggaagcagagcaacaacgcctgttgtttgaaggcggctatccggtgctggcgaaagtcgcaaaacgcaaaggcctgccttatccccacgtcaatcagcaaggcgagatcgaagctgatgccgactggtgggctactatgcaggctgcagggtaagtgccatgaaaggtcgcctgttagatgctgtcccactcagttccctaacgggcgttggcgcagcacttagtaacaaactggcgaaaatcaacctgcataccgtgcaggatctactcttacaccttcccctgcgctacgaagatcgcacccatctctaccccatcggagaactactgccgggcgtttatgccacggtggaaggcgaagtgctgaactgcaatatctccttcggcggtcggcggatgatgacctgccagatcagcgacggttccggcatcctcaccatgcgctttttcaatttcagcgcggcaatgaaaaatagcctggcggcgggccgccgtgtactggcttatggagaagcaaagcgcggtaaatatggtgcggagatgatccacccggaataccgcgtgcaaggcgatctcagcacgccagagttacaggaaacgctcacgccggtttacccaactacggaaggcgtaaagcaggccacgctgcgtaaattaaccgaccaggcgctggatctgctcgacacctgcgccattgaagaactcctgccgccggaactgtcacaaggaatgatgacgctgccagaagcgttgcgcactttgcatcgcccgccaccgactttgcagcttagcgatctggaaaccggacagcatccggcgcaacgtcgtctgattctggaagaactgctggcgcataacctcagcatgttagccttacgcgccggagcgcaacgtttccatgcccagccgctgagcgccaatgacacgctgaaaaataaacttcttgccgccttaccgttcaagccaacgggcgctcaggctcgcgtggtggcggagatcgagcgcgatttggcgctggatgtgccgatgatgcgcctggtacagggcgatgtaggttccggtaaaacgctggtcgctgccctcgccgcgctgcgtgcgattgcccacggcaaacaggtggcattgatggcaccaaccgaattactcgccgaacagcacgccaataacttccgtaactggtttgcaccgcttggtatcgaagtgggctggctcgccggtaagcagaaaggtaaagcgcggctggcacagcaggaagctatcgccagcggtcaggtgcagatgattgtcggtacacacgccatcttccaggaacaggtgctgtttaacggcctggcgctggtgattatcgacgaacagcatcgttttggcgtgcatcagcgtctggcgttatgggagaaaggccagcagcaaggcttccatcctcatcagttgatcatgaccgccacgccgatcccccgaacgctggcaatgactgcgtatgctgatctcgatacctcggtgatagatgagctgccgccaggccgcacgccagtgactacggtcgctattcctgatacccgccgtaccgacattattgaccgcgtgcgccacgcctgcataactgaaggtcgtcaggcatactgggtttgtacgttgattgaagagtcggaattgctggaagcgcaggcggcggaagctacctgggaagagttgaaactggcgctaccagagttgaacgttggcctggtacacgggcggatgaaacctgccgagaaacaggcggtgatggcgtcgtttaaacaaggtgagctacacctgctggttgccacaaccgttattgaagtcggcgttgatgtgcctaacgccagtctgatgattatcgaaaacccggagcgtctgggtctggcgcagttacaccagctgcgcgggcgcgtaggtcgtggcgcggtggcttctcactgcgtgctgctctacaaaacgccgctttctaaaacggcgcaaattcgcctgcaagtgctgcgcgacagtaacgacggttttgtgattgcgcaaaaagatctggagattcgcggccctggcgaattgttaggcacgcgtcagacgggtaatgctgaatttaaagtggcggatttactgcgcgatcaggcgatgatcccggaagttcagcgcctggcacgccatattcacgaacgttacccacaacaggcaaaagccctgatagaacgctggatgccggagacggaacgttactcgaatgcgtaaaaggcggcagtgagaagaccgccatttcaggttaccctaccttcctgccggatgcgattcatcaccctacaaattcaataaattatgaatcaatacgcaggcttgataagcgaagcgtatcaggcatttgtctttgttgcggcggcacttctaccgccgcttcatcggttaaccggcaaaaatcggcaacatcaaatacaacttaattaccagcgcattgacgatatcgataaagaacgcaccgaccatcggcaccaccaaaaacgccatgtgcgacgggccaaaacgttcagtgatcgcctgcatgttggcgattgccgttggcgttgcaccgaggccaaaaccacagtgacccgcagccagcactgccgcatcgtagtttttgcccatcatgcgccaggtaacgaagatggcatacaacgccatgaagatggtctgtaccaccagaatcgccagcatcggcagcgccagcgaagccagctcccacagtttcagccccatcaacgccatcgccaggaacaacgacaagcttacgttacccagcacggataccgcacgctcaaagacgcggtaaaagcccatcattgacagaccgttgctcagaatcacgccaacaaacagtacacagacgaaggtcggcagttcaaaagcagtgccagccaaaagttgcgcaacaattttccccaccgtcaggcagatagcaatcagcgcgatagtttcaatcagcaccaacgaggtgatcatgcggcccacatccggcttttcaaacgccgtcgggacttcctggtcatccggaataccgttcggcgtggtggagtgtttcaccagatagcgcgctaccggaccgccaatcaagccgcccagcaccaaaccgaacgttgcacaggccatcgccacttctgtcgcattggtgaagccataacgttcaatgaacaatttactccacgcagcgcccgtaccgtgaccgccggaaagcgtaatagaaccggccaacagccccatcagcggatcaagccctaacaggctagccataccaatgccaatggcattttgcatcaccaacagaccaacaaccacaatcaagaagatgccaaccacacgcccaccggcacgcaaactggcaatgttggcgttcaggccaatggtggcgaagaaagccagcattaacggatcgcgcagggacatatcaaagttgacttcccagcccatgctttttttcagtaccagtagcgctagcgccaccaacaaaccacccgcaacaggttccggtatggtgtatttcttcaaaaaggagacggaatggaccaacttacgcccgagcagcaacgtcagcgttgcggcaacaagcgttgctaaagtatcgagatgaaacatagttactcctttgtatccgcatcactctttcatactcgtcatacttcatcgcgcagtggcaacctcatgaactatgacgggtatcgagttatgctttcctgggtcaaattctcagctgttaatgaacaaatggcatggattttaagcagaaaaataccaaaagttatataaaaaagtgcatttatctcatttaaatatttagatgaggatgtggcaaacgtttgcttttctctttcggtcagctaaaatgcccgctttgctaccacgggattgttttcgatgtctgtttccaccctcgagtcagaaaatgcgcaaccggttgcgcagactcaaaacagcgaactgatttaccgtcttgaagatcgtccgccgcttcctcaaaccctgtttgccgcctgtcagcatctgctggcgatgttcgttgcggtgatcacgccagcgctattaatctgccaggcgctgggtttaccggcacaagacacgcaacacattattagtatgtcgctgtttgcctccggtgtggcatcgattattcaaattaaggcctggggtccggttggctccgggctgttgtctattcagggcaccagcttcaactttgttgccccgctgattatgggcggtaccgcgctgaaaaccggtggtgctgatgttcctaccatgatggcggctttgttcggcacgttgatgctggcaagttgcaccgagatggtgatctcccgcgttctgcatctggcgcgccgcattattacgccgctggtttctggcgttgtggtgatgattatcggcctgtcgctaattcaggttgggttaacgtccattggcggcggttacgcagccatgagcgataacaccttcggcgcaccgaaaaatctgctgctggcaggcgtggtcttagccttaattatcctgcttaaccgtcaacgtaacccttacttacgcgtggcctcactggtgattgcgatggcggccggatatgcgctggcgtggtttatgggcatgttgccagaaagcaacgaaccgatgacgcaagaactgattatggtgccaacgccgctctattacggtcttggcattgaatggagtctgctgctgccgctgatgctggtctttatgatcacttcgctggaaaccattggcgatatcacggcgacctctgacgtttccgaacagccagtgtccggtccgctgtacatgaaacgcctgaaaggtggcgtgctggcaaacggcctgaactcgtttgtttcggcggtgttcaacaccttcccgaactcctgcttcgggcaaaacaacggagtgatccagttgactggtgttgccagccgctatgtcggttttgtcgtcgcgctgatgttgatcgtgctgggtctgttcccggcagtgagcggttttgtacaacacattccagaaccggttctgggcggcgcaacgcttgtaatgtttggcaccatcgccgcctccggtgtgcgtatcgtttctcgtgagccgctgaaccgtcgggcgattctgattatcgcgctgtcgctggcggttggtctgggcgtgtctcagcagccgctgattttgcagtttgcccctgaatggctgaaaaacctgctctcctccgggatcgccgcgggcggtattactgccatcgtgctgaatctgattttcccaccagaaaaacagtaattcactggcggcggtaagataattaccgccgcagtctcacctctttaaccattcccgccttgaggattgcgcgtaaatcgtgcataactcccttatgtgcatttcacgggatggaagaccatgaaatttattgggaagctgcttctctacattctcatcgctctgttagtggcgatcgctggcctctattttcttctgcaaacccgctggggagcagaacatatcagcgcatgggtttccgagaatagcgactatcatctggccttcggggcgatggatcaccgtttttccgcgccatctcatatcgtgctggagaacgtcacgtttggtcgtgatggccagcccgcgaccctggtggccaaaagtgtcgacattgcgctaagcagtcggcaactgaccgaaccacgccatgtcgataccatcctgctggaaaacgggacgctgaatctcaccgaccagaccgcgccgctaccgttcaaagccgatcgtctgcaactgcgtgatatggcgtttaatagcccgaatagcgaatggaaactgagcgcgcagcgggtaaatggcggcgtagttccgtggtcaccaaaagccggtaaagtgctgggtacgaaggcgcagattcagtttagtgccggatcgctttcgctcaatgatgttcctgccaccaatgtactgattgaaggcagtattgataacgatcgcgttacgctgactaacctgggtgccgacatcgcgcgcgggacattaaccggaaacgcgcagcgtaacgccgacggcagctggcaagtggaaaacctgcgcatggcggatatccgtctacaaagcgaaaaatcgctaaccgacttctttgcgccattacgctctgtcccgtcgttgcagattggtcgcctggaagtgatcgatgctcgtttgcaaggtccggactgggcggtgaccgacctcgatctcagcttgcgcaacatgaccttcagtaaagatgactggcagacacaagaaggcaaactgtcgatgaacgctagcgagttcatttatggttcgctgcatttatttgacccgattataaacgcggaattttccccgcagggcgtagcgctgcgccagttcaccagccgctgggaagggggtatggtcagaacgtcagggaactggctgcgtgacgggaaaacgttgatccttgatgatgcggcaattgccgggctggaatataccttgccgaaaaactggcaacagttgtggatggaaacgacacccggttggttaaacagcctgcaactgaagagatttagcgccagccgcaatctgatcattgatatcgaccctgacttcccgtggcagctcaccacgctcgatggttacggtgccaacctgacgctggttaccgatcataaatggggcgtctggagtggctcggcgaatctgaatgccgccgccgcgacattcaatcgtgttgatgttcgtcgcccgtcgctggcgctgaccgccaacagcagcacggtgaatatcagcgaactgagtgcatttactgaaaaaggcattctggaagccactgccagtgtttcacaaacgccacaacgtcagacccatatcagcctgaatggacgcggtgtgccggtgaatattttgcaacaatggggatggcctgaattaccgttgactggcgacggcaatattcagcttaccgccagtggagatattcaggccaatgccccgctgaaacctacggttagcgggcaattgcatgccgtgaacgccgcaaagcagcaagtgactcaaaccatgaatgctggcatcgtttccagcggtgaagttacatcgacggagccggtgcggtaaacatcaatctcgccgggtacgactcagacgtacccggcattccatcaatagattacaacgtaattgtcagcgcattcccttgaggcttcaccaccagcccctgctcactttcagcctgcgaaccgtcttgcagaccatttactttcacaacattgcgcaggcacagtgtccagttcttcgcctcgcccgcaccagtcacagtaatcgtgttgccagtacgtgctgcttttaaagtaaagatcaccgatccgtcagcagcgggcacttcacagacggcttcatgcccgtcttgcagattaaagaggtggaatgccgtgccttcgtgccacacgtaatcgggacgttgatcgttgttgcccagcgccagtagagtgttatcacgcacataaacgggcagactcaggaagccgtgctgctgtttatgccagcgactaccgtcgagttcatcgttgtgccacaggtgtgtccagcgaccttccggcaggtagaactgcacatcgcccgcttcagtgaacaccggcgcaaccatcacgttgtcgcctaacatgtattgacggtcaaggtaatcacaagccggatcgtccgggaactccatcatcatggcccgcatcatcggcgtaccccgcgcgttcgcacgcgcagcttcacgatacagatacggcatcatgcggcatttcagttgcgtgaagaagcgcaccacatcacaggactcatcatcgtaggcccacggcacacgataagatttgctaccgtgtaaacggctatggctggagagcaaaccaaacgcgcaccagcgtttgtaaacgtgcgccggagcggtattttcaaagccgccgatatcgtggctccagaagccaaaacctgaaaggccaatagacaaaccaccgcgcaggctttccgccattgattcgtagttagcgtaacaatcgccaccccagtgtaccgggaatttctgcgcaccgacggaggccgagcgggcaaacaagacagcttcttcctcaccaacggtgtccttgagcacgttccacaccagttcgttgtagatgtacgcataatggttatgcattttctgcggatcggaaccgtcaaaccactgaacatcagttgggatacgttcgccaaagtcggtcttaaagcaatcaacgcccatcgcgaccagacctttcagtttgtcggcgtaccatttgcaggcatccggattggtaaagtcataaatcgccagacctggctgccatttatcccactgccatagcgaaccgtccgggcgtttgagtaaatagcctttctcttgtaactctttaaagacgggggatttttgaccgatataggggttaatccagatgcagattttcagccctttcgctttcaggcggcggatcatcccttccgggtcagggaaagtcagcgggtcccactcaaaatcgcaccactggaaggctttcatccagaaacagtcaaagtggaaaacatgcagcggcagattgcgttccgccataccatcgataaagctgtttaccgtcgcttcgtcgtagttggtggtaaatgaagtggttagccacaggccgaaggaccacgcgggcggcagcgccggacgaccagtaaagcgggtataacgatcaagtaccgctttcggcgtcgggccgtcgataacaaagtattcgagatattcactctcaacgctgaactgcactttggagactttctccgatcccacttcaaaagagacacactggggatgattgaccagtaccccataaccacggttagtcatgtagaacgggatatttttatacacctgttcagtacttgtgccgccgtcccggttccaggtctctaccgtctggccattgcgcaccagggcagtaaagcgctctcccagaccgtaaactgtttcgccaacgccaagatcaagccgctcaaacatataattgcgttgattattcgtgtcctgcacgtagccattatttttcacctgactaccggtaatacgttcgccgttgcgcagaaaatccagtgaccagaactcacctttgctgacacgcgcgcttaagttgccacttttaaactcagcataacgttctgtgttttcgattgtgaccttcacgtcctgcaaaatattgagcggataatgaggaccgttattcagcgccccctgaaaatgctcaatccgcacaccgacaataccttcctgtggggagaaaaagcgcagcgtaaataaaggcgtgtcaagctgccaggtacgttcacgtacatcacggggggcagcatagaccaccatttcattatcctgctgttcaacctcgaacacctgaagcgggtgaatcaaattgaggccaggttgaatcaaccagtttccatcgctaattttcattgccgttccttagttctgcacttcttgagaggtgaattgttgctggcaacggcgtttaccctgagccagctgttccataacggttttcagattgtgcgtcgtgagtgagtagtagcgtttagcgataatcgcgctcagcaaataacagatcgccggaacaatcgtgaatagcgcaataatgatgctaatcgtggcgctgttctgcgctttttctgccgcatcatatccgccataagccagcatccagccgataagagcgccgccgaaggccaaccccagtttgagcacaaacagcgtgccagcaaaactgatcccggtcaggcgtttaccattgcaccactcgccgtagtcgacggtatcggacatcattacccactggataggtgtcaccagttgatgcaacacaccaatcacgaagatgaagacaaacatagtgatgctggcctgcatgggaacaaagaacatcgcgaggctaatcactgccagcagggcgttcgtccaccagaagatagtgactttacatttccagtcggtcagaggttttgccagtgcggaaccaatcaggttacccacgcaataagtggtgagaaaagcgacaaacacttccggcgtgcccaaaatccatgtgacgtaatacatcatcgccccaccgcgtacgcacaccgccaggatattgaaaatggttagtaaaccgacaatccgccactggtcgttttgccagatatcacgtaaatcttcccgcatagacgttgttgtaggtggtgcttcaacgcgttctttagtggtgaagaaacaaaatgccagcatcatgaatgccaccacggaaaggaccgcgataccgccctggaaaccgagtggtttattatcaccgccaattaaattaaccagtggcatcatcagaacagtagaaagcatgcctcccgcggtcgccagcacaaaacgccaggattgcagcgagatacgctgagtcgggtcattggtgattacaccacccaatgcgcagtaagggatattgacgacggtataaagtaaggtaagtagggtgtaagtaattgctgcatagatcattttgccgttcatactgagatctggcgtgctataggccagtacacagacgatcccgaatggcagtgcgccaaacagtacccacggacgaaatttaccccagcgagagcgcgttcgatcggccaacaaccccatgcaaggatcggaaatcgcatccagtgcacgagcgaccaaaaacatggttccgacaaaaccggcaggaatgccaaaaatatcggtataaaagaacatcatatataacattacgttatcgaaaataatgtggctggcggcgtctcccatgccataaccaattttctctttaacggacaacacttcactcttcatctgcttttccttgatgctataggggtgctgagaccgataacgcattttgtaaaccatccctgtgagagcgaatattccgatatctggttattaatttatgattcttgttttatgtgatcgtggtagcgttaattccgctcatatatcattgtaaaatatgggttttatatgaactataatgctttcgtgataatacgctgcgtgtattaggcggaaaaaactgatctgggggatgtagaaactcaaggaagtagctataatgcgccccgcctccatgtagcaatcgaggcgcggaagatcgtcgtctccggtgaggcggctggacttcaaatccagttggggccgccagcggtcccgggcaggttcgactcctgtgatcttccgccaaaatgcctctcctgacgttctccaaccccttgtaatactgtcaatccagatattttctactgctcaatattcaatcggcttcaggaatacctggtctaaggttttgtgatggacgatgaacggctgaagaatccgcctgtcggttcttctgtcctcgaacgcatccgcgatattcacgccagtatgcgccgtgtttatttgcaggtgatttgcccccctgctgactctcagccaactgtatcgccattaaggtgaagatgttgttttactcgccccagaacacccttttttatacgactattctatttctttaaccgctggcgaaaaaaactgactataaacttcaccaataatcagactgccatcaagattaatttgttcatttaatatatcaaatcaacttgttttatttttactatcaaaaatagctcattgccttactataattaatatataaattcggtaattaattcttaacatgcttttgctaataatctcaattgctggccctataatattgcgctagcattgctttctggttgtatcagcgatactcaaaaattcttaatacaatactcattcgactggtacttatttgtaactcagttatattttttcgcccggtgattcagaagaatgcaaaaaacggctaccactccatcaaaaatacttgatctcactgccgcggcatttttacttgtcgcctttctgacgggtattgcgggcgctcttcagactcctaccctaagtatattcctcgcagatgaactgaaagcccgtcctataatggtaggttttttcttcaccggtagcgctattatgggaattctggtcagtcaatttctggcaaggcactccgataaacaaggcgaccgtaaattactgattctgctatgttgcttatttggagtgctggcctgcacgctttttgcgtggaatcgcaactacttcattctcctctcaacgggcgtacttctgagtagttttgcttccaccgcaaacccgcaaatgttcgccctcgcccgtgaacacgccgacagaacaggccgtgagacggtcatgttcagtacatttttacgtgctcagatctcgcttgcctgggttatcgggccaccgctcgcttatgaactggcaatgggatttagttttaaagtgatgtatctcaccgctgccatcgcatttgttgtttgcgggctgatagtctggttgtttttgccatcaatacaaagaaatattcctgtcgttacccaacccgtagaaattttaccctccacccacaggaagcgggatacgcggctactttttgtggtctgttcaatgatgtgggcggcgaataatctctacatgataaatatgccgctatttattattgatgaactgcatctaaccgataaactggctggagaaatgattggtatcgctgccggtctggaaattccgatgatgttaatcgcaggctattacatgaaacgtattggcaagcgactattaatgctcattgctatcgtgagtggaatgtgtttttacgccagcgtactcatggcgacgactccggcggttgagctggaattgcaaattcttaatgccatcttccttggtattctctgtggcatcggcatgctttattttcaggacctgatgcctgaaaaaataggctctgcgacaacgttatatgcaaatacttcacgcgtcggctggattatcgccggctctgttgacggaattatggttgaaatctggagctaccatgcgttgttctggctggcgatagggatgttgggtattgcgatgatttgcctgctgtttattaaagatatttagctcaccagtctgggctaagaaaaatcggcgtggcgcaaacagagccatcctcgccatttttgctatcatgcctgcatacataaacgacaaaacagtatgcagagggaaaaatgggttccaccagaaaggggatgctgaacgttctgattgccgccgtgttgtggggaagttcaggggtctgcgcgcaatacatcatggagcaaagccagatgtcgtcgcagtttttgactatgacgcgtttgatattcgccggtttgattctactgacgctgtcatttgttcatggcgataaaatcttttctattattaacaatcataaagatgccattagcctgctgattttttccgtggttggcgcgctaactgtacagctcacttttttgctaaccatcgaaaaatcgaacgcagccacggcaacggtgctgcaattcctctcaccgacgattatcgtcgcctggttctcactggtgcgtaaatcgcgcccgggcattctggttttctgcgctattttgacatcgctggtcgggacttttttattggtgacacacggtaatccgacgtcattatcgatctctcctgccgcgttgttctggggcattgcctcggcatttgctgctgcattctataccacctatccctcaacgctaattgcccgctatggcacgttgtctgtcgtcggctggagtatgctgatcggcggtctgattctgttgcctttttatgccagacaagggacaaactttgtcgttaacggcagtttgattttggcgtttttttatttgatcgtcattggtacgtccctgacatttagtctgtacctgaaaggagcacaattaattggcggtccaaaagccagcattttgagctgtgcagaaccattaagtagcgcgctactctctttgctgttgctggggatcacgttcacattaccggactggctgggaacgctgctgattctgtcatcggtaattttgatttcaatggattcccgtcgccgcgccagaaaaataaatcgtccggcgcgggatgagtgagaattaccagccaggcaccgcgccaccgttaaagatggtttctgccgctttagcgacttcggatgattgataagattgcagaaattccttcacgttttctgcattcttattatcttcccgtgccaccaaaatattcacatacggcgaatttttatcttcaataaatacgctgtcgtgcaccggagaaagcccggtctgctgaatgtaagtggtgctgataatcgccacatcaactttgggatcatccagtacgcgcgggagctgcgccccctcgagttccataatctgcaaatgacgaggattatcggttatatccagcgcggtaggtaataacccttttccctctttcagagtaattagcttctctttttgcaacagtaaaagtgcgcgaccaaggttggtcgggtcgttggggatcgccactgtcgcgccttcttttatttgcgccacggttttgatttttttggaataacccgccatagggaagacaaacgtatttcccaccgctaccagtttataaccatgcgcctgattatcttgttcaagaaagggtcgatgctggaagacattcgcatcaagttcgccatgatttgtcgcatcgttcggtagcaacgaaccgctaaatcctaccagttcaacatcgaggccatatttctcttttgccacctttttagcgacttccgcgacatcttgttctgcgccatttataacgccaactttaatgtgttttgcatcgctgctactctggtcgcaacctgccagcagaattccggccagcaataatgcggcccctgtccgtagatgatgtgttgtcagtttcatttttttatccttttattaatgattacctgactatagcggtaaggtcgctgcggtttaaaaaacgaaacgctatcgataagaataaaaaggaataaaagtggaatataaagtctggcacttcttactgaccacgcaagcgcgtttcgtacagcatgatgagagcgatgaaagcaaactacacttatgcttcattcgatacacatttgtaaaaggttgaatccatgaaaccaacgacactactgcttattttcacttttttcgctatgccaggcatcgtatacgccgagtcgccttttagctcactgcagtccgcaaaagagaaaaccacggtattacaagatttacgtaaaatttgcacgccacaggcgtcattatcagatgaagcgtgggaaaagttaatgttgtcagatgaaaacaataaacaacatatacgcgaggccatcgtggcgatggaacgtaataatcagagcaattattgggaagcgttgggtaaggtagaatgcccggatatgtaagaacagcaacaactactgaccaacgcttctttacctgatatcaggatttcttcattttcacctttgcagtaaccaacaatgcagtcagcaacatcaatgtgccggacaacatcaacggcgaagtcagaccaatattatccagcgcataaccgccgattgccgcgccacaggtattagcaagctgaataaccgccacctgaatagacccggctttttctgcctgatcggccagcgagcgggtgatccacgttgaccagccgacgggaaccaatgcaaaagttagcccccagataatcgccacgccggtagcaacgattttatcgcttccccacaacgtcagtaccaacgcactcacagccagtattaacggcgcgcctgctaaggccagttttaccgaacgtttaagaatgaacgacgaaagcgacgtaccaataaagctggcgataccaaaactcaacagcaccagcgttaagccatccacgccgaatcccgccaggttcatatacaccgggcgaatatacgtgaagaaagcaaactgcccggcgaaagacatgaagatggcgatcatccctgccatcacacccggacgttgtaataagcggaaagtattttgtttctgatgcgagggttcgcctggcagtgaaggcaatgatttgataatccagaaaatacacagcacgcccatcaccgccgccgcattaaagacattgcgccaaccgataagctcgcctaaaaaactgcccaacggcgcggcaatcaccagcgcaatagaaaccgcgccgaagatcaccgacagcgccttcggcaccgtacgcggcggcaccagacgcatggtcagcgacgccgacatcgcccagaacccgcccagcgccagccccagacaggcacgaccgattaaaagcaaactgaatgagttagcaaaggaaaccagcaagcaggagagcgtcagcaaaacggcaaacaaaataacaacgtagcggcggtcagtagcctgaattgtctgggtaataaacaaactggcaaacattgccacaaaggcggtcacggtcaccgattgcccggcaaccccttccgaaatgcctaaatcctgggccattggcgtcaacaaactgacgggcaaaaactcaacgataatcagacaggcgacacaaaacgccaccgagaaaacggctgaccagttcggtcgggtgatggcatccgcgccgcggttttcggcaataaattcactcatggtgttacccgtggcatgtttcaggggaaaagccgaccactttaacattgaaatgtgtgacgcatttaacgtttttgcaacttttacggtgttgcttgagctggagttaagatcgaaacggaacagggcaaagattaccggatgcggcgtgaacgtcttatccacccgacaggtcaggcgcggtctgtaggctgataagacgaaacggtttcaatgcaaccagtgaacgccctcggcaggctgaaagaacgcgttatagcgcatctgaaaagcattaatatcctgcatttcaggttcggtttcgcgcagaaaacctagcgccagcctgacctgagcgtcggtaatcggcgcggcgaggcgagctttttgtaaaatccgatgccattgcagcaggttctgttcgctaccatcgacaatgacaatttgccagatgagcaacacctgcgcggcgttttgcaggtgcgactcatccggacgatgcaaataacgtaaaaattcgtcaccagctgactttcccatttgatcgaccatcgactccacgggtacgacatcgatgttcagccgatcgctgagacggcgaatcgcttttctggccccggatgtcagcacccgaaaaccaaccacaaacactaccgccagcgtggcgagcattatccagatcatgagttctcctgcgtaatcagaactcatgatatctggaaaccctcgccagttactaatccaccagaataatcttcagtgcaaacagagctgcgaccaccaccacacacaggttcagatcgcgccagcgcccggtgcatactttcatgatgcagtacgacataaagccgagtgcaatcccttcggtgatcgagaaagtaaagggcatcatcaccgtggtaataaacgcaggcaccgattcggtaaaatcatcccagttaacgcgcgccaggctcgaagtcatcagcacgccaacaaagattaacgctccggcggttgcgtaaggaggaactatcgccaccagcggtgagaagaacataaccaacaggaacataacgccaaccacaaccgcagtcagccccgtgcggccaccgactgccacaccagaagtactttcaatataggcagtaacagacgaggtgccgataaacgcacccgccaccgaactgacgctatcaacatacagcgccttattcatattggggaatttaccgttaccatctattaagcccgctttatcagttacaccaattaatgttcctgatgaatcaaataggttgatcagcataaaggagaaaatgataccggcgagttcaagtgttaacgcgccgctcaaatctacttcaccaatgacgccgctaatatcaggcggaatggaatagacgccgctaaaatgaacatcaccgaaaaataatccacagcaagacgtcaccacaatagaaaccagcaccgcggcatgaaaatgacgtgatgacaacacggttataataaaaaaccctaaaatacctaacaacacgccgtgagaacttaaatcgccaatcatcaccagcgtgtctttattggcgacaataacgccagtattttttaatcccattaaggcgataaataatccaattccgctggtgataccaatacgtaaacttaagggaatgttggagatcatccagtaccggatacgaaacagcgtgagcaaaaatagtccaactgcgccccagaatattgcgcccatcccggtctgccaggagatgcccatcgcccccacgaccacgaaggcaaagaaggcgttcagccccattgccggagccagcgccacgggtaagttagcaaatatccccatcgcaatactgccgataccggcaatcaaacaggtggtaacaaacaccactttcgggtccatttgtgccgcgccgaggatttgcgggttcacaaaaacgatgtacaccatggttaaaaaagtggtcatccccgcaatcaattctgtgcggacggtggtcccatgctgaggtagtttaaataatcgcgaaagcgtccctgattcattactcacgtaatcggtattgtcattattcatttttttgtccattggaggagatttaatcccttgcttttgtaaaacaaatgacaacaacggttcagtgataattatcacatttcaattgcacattaatggatattctttaataatctcgcgacgtttctttatgataaataataatcaaattgataaaatcaaaatgagaaaaatatgaataattctattaaccataaatttcatcacattagccgggctgaataccaggaattgttagccgtttcccgtggcgacgctgttgccgattatcttattgataatgtctctattctcgacctgatcaatggcggagaaatttccggcccaattgtgattaaaggacgttacattgccggtgttggcgcagaatacgctgatgctccggctttgcagcggattgatgctcgcggcgcaacggcggtgccagggtttattgatgctcacctgcatattgaatccagcatgatgacgccggtcacttttgaaaccgctaccctgccgcgcggcctgacgaccgttatttgcgaccctcatgaaatcgtcaacgtgatgggagaagccggattcgcctggtttgcccgctgtgccgaacaggcaaggcaaaaccagtacttacaggtcagctcttgcgtacccgccctggaaggctgcgatgttaacggtgccagttttacccttgaacagatgctcgcctggcgggaccatccgcaggttaccggccttgcagaaatgatggactaccctggcgtaattagcgggcagaatgcgctgctcgataaactggatgcatttcgccacctgacgctggacggtcactgcccgggtttgggtggtaaagaacttaacgcctatattactgcgggtattgaaaactgccacgaaagttatcagctggaagaaggacgccggaaattacaactcggcatgtcgttgatgatccgcgaagggtccgctgcccgcaatctcaacgcgctggcaccgttgatcaacgaatttaacagcccgcaatgcatgctctgtaccgatgaccgtaacccgtgggagatcgcccatgaaggacacatcgatgccttaattcgccgcctgatcgaacaacacaatgtgccgctgcatgtggcatatcgcgtcgccagctggtcgacggcgcgccactttggtctgaatcacctcggcttactggcacccggcaagcaggccgatatcgtcctgttgagcgatgcgcgtaaggtcacggtgcagcaggtactggtgaaaggcgagccgattgatgcgcaaaccttacaggcggaagagtcggcgagactggcacaatccgctccgccatatggcaacaccattgcccgccagccagtttccgccagcgactttgccctgcaatttacgcccggaaaacgctatcgggtcattgacgtcatccataacgaattgattacgcactcccactccagcgtctacagcgaaaatggttttgatcgcgatgatgtgagctttattgccgtacttgagcgttacgggcaacggctggctccggcttgtggtttgcttggcggctttggactgaatgaaggtgcgctggctgcgacggtcagccatgacagccataatattgtggtgatcggtcgcagtgccgaagagatggcgctggcggtcaatcaggtgattcaggatggcggcgggctgtgcgtggtacgtaacggccaggtccaaagtcatctgccgttgcccattgccggcctgatgagcaccgacacggcgcagtcgctggcggaacagattgacgccttgaaagccgccgcccgtgaatgcggtccgttacccgatgagccgtttattcagatggcgtttctttctctgccagtgatccccgcgctaaaactaaccagtcaggggctatttgatggcgagaagtttgccttcactacgctggaagtcacggaataataaaaaagcccggcgtcatgccgggcaaaagtcaccagttacgtttatgccactgtcaactgctgaatttttttctcgcggcggattttgcgttcttccatcaccgccactatcgccatcaggcagatacaaccaatcgcggcgatatcaagtgcggcgaaggtgcctgcccagccggtaaggccgaataccggcgtcccatcggcaatcattcccagacctaacttggcaaagctgtcaccaatcaggtaagcaaaggtgcctttaataccatcggcagcgccaatcgcttttttaggtacaaagccaacagcagccacaccaatcaacaattgcgggccaaagaccaggaaacccaacgcaaagagagaagccagatagatatattcgttgctggcatgttgatacacaccgagcgtggcgataatcagcgccagcgcgatgcaggccaccaggccacggcgaccgttcgccaggtcagagagccagccccacagcagcgtaccgaccagcgcaccagcttcaaacagcgtaaagccctgaatcgccaccgctttagagagtttcagttcctggaacgcgtatacggttgaccactggtcgataccaatacgtaccacatagaggaaaatgttggcgaagcacagcagccagatcactttgtttttcagcacatactcaacaaagatctgccacttggtcatatcggtagattctgtctctttgtcctcttcgctgatctcctcgccgaacagttcttcagctttgccgaggccataagattccggggagtcgctgccgtaacgcaggccgataaaaccgacaatcagcgcgataatcgacgggaagataaacatgccgatgacatggccatcgaacaggtaatttgccccgaacagcgccacacctgctgcgcctgcaccgccaaggttgtgagaaatattccagaaaccgaggaatgtcccgcgtttacgacgcggcgtccatttggtgatggtggagtaactgcacgaaccgccggtactctggaaaaagccgcttaaggcgtagaaggcaatcatcaggaacaggctaaccgagccgctgcccatactggcactgaagcccagcatacaaatagcagagaggatcagcatgaacggcaggaattgtttggtgtttttgccgtcggcgtagtaggaaaccagcgttttacccacgccataagtgatggagaaacccaggccgatcatccccagctgcgtcatgctcaacccgtaggtcgaaatcatatcgttctgcgcgatgttaaagttcttgcgaatcaggtacatcgtcaggtagccgataaagaccaccaggtaggattgcatgaacggtttgaaccacattttgcgccgcacttcgagcggaaggtccagggtcggcttgcgaacctggtttaagaaagccagcatgggttactcctgaaatgaatacctgcgtgaggcatgcattgtaaaaatcagcagcaaatcaggcctgagatagcgtccaggcaaaacctggaaaatttcttagttttgccggatatgaagtgaaaaggtgagatgcatcacgcttcgcgcggtgtctgggcgttcaaaaagggcagtaacagcagtgcggaaatcccggcggcgatagagataaccacaaaaaatccgctccagtgccaggtatcgagtactttcgccagcggccaaccagcaagcgacgcccccagataagcaaacaagccgacaaaccccgtcgccgcccctgccgcctctttgtgggaacactctgccgccgccataccgattaacatctgtgggccaaagacaaaaaaaccaatggtgaagaagcaggttgcctgcatcacgtagctggcaaatggcatcagccacagggagccgactgaaagcaaaattccggcggcgaaaatcaaattcatcggccctcggttgccgttaaacaatttgtccgagccccaacccgctaccagcgcaccgataaatccacccagttcaaacatcgtcactgccgtattcgccgtgaccagatcgacgcccagcgtctcggacatatacaaattgccccagtcgttgatcgccgcccggaccacatagaccagcacatagcaaaacgaaagcagccagatatacggattcagcaacacatatttggtgaggatctctttacgcgtcagccctgccccttcttgttgttgagctatctccagcgcgtcgtgtcgccattcaccgaccgccggtaaacctaacgcctgcgggcgatcgcgcagccgccagcagagaaaaattcccacgacgatcgccatacaaccagcaatcatcatcccggcacgccagccgtaatgtagtgcagccgctgccatcacaatgggaatgagtgcgccgccgacgttatgcgccgtgttccataatgcccaccaaccgccgcgctcggtacgagaataccaggcggttaacagacgcgcacacaccggtgaaccccagccctggaaaaaggcgttcagcacccagagtacggcaaacgcccatagcgacgtcgagaagccaaacagaatgttgataatgcccgtggcgataagccctatccccataaaataacgggcatttgagcgatcgctgacaatgccggagacaaacttcgacacgccataggtaatgtaaaacagggtcgctaacaggccgatatcgctacggctgagcacgccgttagcaaggatttctggtacggcggcgttaaaacttttccgcgtgaagtaaaacagcgcgtaacccagccagatggtcagcagaatatgccgacgccagtagcgatagcgggcatcaatttcatatttatcagtcattaatggcgcatcggcaggcgctttcagaaacggcaacatcatcaaaccttagacatagcgttgaggtagagaaacgctgacacgcgtgccgtgcagacaggaaatgtgtaatgtgccacccagcgccgttacgcgctcgcgcattccggtgaggccaaaaccttgttgcccggaacccggcggcaaaccgctgccatcgtcttcaataaccagcatcaaccgttcatcctgctgccagccttgcagggtgaccgcgctggcatcagcatgtttcacaatgttgttcagcccttcctggcagacacgaaacagcgtcacgcgctggttttcgcttaacgctgattcatcgattcgccattcgagatggctgacaataccgcgcccttccagctccatttcccgcatcagtgagcggatggcctgctccagggtgagatcatccaactggcgcggacgtaaccgacccaacaaacggcgcaccgcgtcgtaaacgcccagcgatagttgttcgatgagctgcccgctctgcttcacgctggcgttatctgccgccagccgctgaacaatgcccgcctgagtacgaatagcagtgatggtctgaccgatatcatcatgcagctcacgcgccacatcacggcgcacgctctcttcggtttccagcaaccgttcagccagatgctgattgcgcgccagttccttttgcagcgactggttaagttcacgcaaccgctggatgccagcgccaagcaacaaccctgtcagactttgcaccagcagcgagagcaataaatccaccggatgatcgcgccaggtttgactggcgatcagcgcgatggcgttcatcaacgtcgcaatcagcgccccttgccaaccatagtgccaggccagcgcgataatcggcagcgccagacagaatggcgtaaagcgcgacagttcgtccggcaatcccaactggagccagagactgataacaaacagcagcaagtaccagaccagatgtcgcccgcgccagttgattggctgagaaaccagtgacgggccgagcggcagccaggtgttattggcgagatagtgccagaacaccagacatatcggggccagcgtcaggccgccagttaaagtcagcaacagcgcattccacgactctttgccgtgccaaagccagggcagcgactgcaacaacgccgccgccgttaacgccgccccctgtaacagcaaggtgcgccagtcacgctgatggcgatagcgcgagatcagcgctacgggcagtaacgtcagtaaactaccgatcatcaataacggaaaatgggttaaaccgaccgcctgcgttagccagtaaatcagcagccactccgcgcccagcagcaccggccagtatccgcgcgggcattgcagcattagccccagacgcagaccaaacggaaataacagcaccgccatatcagggcgctcaaccagatgcaggctgatactccacaggcaaaaccatgcggcagagaagataaaaaagcaggcaataacggtaattaagcgggagaacaacgtcttcatcaccagccatcaaacatgcggcgcgccagctctacgtcgttactgacgcccagtttttccatcagattggcgcgatggacgtgtaccgttttcggtgacaagcccagttcggcggcaatctctttcaccgccattccttgcgccagtttttccgccacctggcgttcacgtttggttagcgggtcctgacgaccggatgccagtttaatggcaatatccggcgtcagataacagccgcccgtggcaaccgtatgcaccgcagcaatgagttcatccgggctacagcgtttggaaagaaagccgcgtgcccccgcgttaagcgcctgctcaaccagcgcaggactgtcgtgaacggagagcataatcgtcgccatacctttcggcagctggcttagcagctccagaccggagatatcgggcatggagatatcgcaaatacacacctgcacaccgcgccccggcagccccgccagcgcctcgcgccccgaaccaaactcggcaactacctgcaaatcaggttccagccccagcagctgcgcaaagccggagcggacgatgaggtgatcgtctataagggcaacggtgatcatggtcttgtcctggcgggtaaaaaaaaacgcgcttaccttaacgataagcgcgatgttgttcaagccttgagcggttactgaaaaaacaccgcgatcttgttaaacatcgtcggatcggactgattacgctgcactttcacgacatcttccagcttatcgatttggcttatcatctgctccagacgctggtcgtcattgaccagtagccagatatggcttttgtcgctgtcctgaatcggcagacaaagaatgccttcaacgttaaaagcgcggcgggcaaaaaggccacaaacgtgggtcattacgcccggatggttgcgaacggtgagctccagaattacgttgtcatgagttgtgttttgcatggcttattcccccaccatttcagtattcgccgcacctggcggcaccatcgggtaaactttttcttcggcatcaatgcgcacatggatcagcgccgggccagggcgattgatgatttcctgcaatgcagcctgcggatcggcttcgttattcaaatcacaggtttcgaggccgaatccggcggcaatctgcataaagttgattttgcccggataggtggcggcaaaaacgccttgctcgtagaacagactctgttgctgatgcaccagccccagcgcttcgttgttcatcagaatgattttgacatccagctgattttcactggcggtcgccatctcctgaatattcatcatcaggctgccgtcgccggagaaacacaacactttgcgatccgggttcgccagcgccgcgccaatcgccgcaggcaggccaaaacccatcgtgcccagcccaccggaggtcagccactggcgtgggcgattgagcggataagcttgcgcggtccacatctgatgctgccccacatcggtggtgataatcgcattgtcatcgacacaggcggcaacggcgttgatcaggccgtaatggcttaatggatcgcacgctttcgggattggacacggaaactcacgctgcaaatccgctaccaactggtgccactctgcacgcggttgcgcttccaccagcgggatcaactgcgccagcacgtcatcaacatccgcctgaatcgccacatgcggctgcttgattttacccagctctgcacggtcgatatcgacatgaatgattttggcattcggacagaactgctcggttttgccaatcgcccggtcatcaaaacgcgcaccgagcacaatcagtaaatccgcctcctgcaagatatagttagtgctgcgcacgccgtgcatccccagcatacccagcgacaacggatgcgcttttggcagcatgcccagcgccattaaagtcatggtggtaggcagttgcgctttctccgccagttcacgcacccgcgcaggcgcattgatcacaccaccacccagataaagcaccgggcgtttggcagcgttaatcattgtagctgcgtcacgaatgctttcttcgctaaaggcgggtgcagcggctttttctgccaccgcgggctgagcttcaatctcaaaaaccgccgtttgcacatccttaggaatgtctatccacaccgggcctgggcggcctgattgcgcaatgcggaaggcatcgctcatgacctgcgggagttcttcgatatgtctgaccagatagttgtgtttggtgatggggatagagatgccgtaggtgtcgacttcctggaaggcgtcggtgccgatcatcgaggcgggaacctgaccagtgatgcaaatcagcgggatggagtccagccgcgcatcggcaatggcggtcaccaggttagtcgcacccggtccgctacaggccatacagaccgccggtttaccgtcggtgcgcgccattccctgagcgataaatcccgcgccctgttcatggcgagccagaatatggcggatttgcgtactttggcttaaggcatcgtaaacaggcaggatagaaccgcccggaatgcccgtcacaatcttaatgccctgctgttccaggaaatgaacgataaattctgcgccggtaaagcgcttacgcgtcgatgttgtgcccgaacttgccatgctccagtccttttcttctgggccgactttccgggaggtgcttaaacgaaaaaccccgcccggtttgcgccggcggggttttggaatcgtgtgttgttccagtccctacggcgcattgccgacgaccaccaccacacgcacgacgaccactgcggcggatggcgcagttggtagtagttttgcgttgaacatggaagtagtcattggggaccttgttggttttgtgtttaacaatatttatacaagcacagctttacaggggagacaatggaaaatttttcagcaagggaaaattgaggggttgatcacgttttgtactgaattgcagataacaaaaaaccccgccggagcgaggtttcgtcagtcgcctgcggctggtaaccgcaaagcacactgtattatgtcaacactgaaagtatacgtgttccgcgcagaacgcgcaatttcggcacgaattttgacgtatttagtgcatagttgagtatcgatcacagtttgcgttttgtccaaatattactgtttatttatacagtaaacttctataatatcactgtacgcaatgtgttatgcgggggccgcatcgttacccggcgcactaagtcctggctgaaacgggtggtgccgtcagcgccttaaccccgcgtgagcacactgtgttatgtcaacaagcacaacgtttctccttgagataccgcgtgcacaacagctggcaacaggcagcggaaaggtacgtcagctggcagtgctcctgaaccacaggagacgcgtatgagcctggtggatatcgccattcttatcctcaaactcattgttgcagcactgcaactgcttgatgctgttctgaaatacctgaagtaattcagattcaagtcgcaccaaaggggagcgggaaaccgctccccttttatatttagcgtgcgggttggtgtcggatgcgatgctgacgcatcttatccgccctaccatctctcccggcaacatttattgccgcttttgtttacatattctgccgctaaacaattccccattcctggcgtatatctggctaacattcatcaatgtgatagattcctctcccgcatttatgggaatgcgtagtgacttattctaattatttttataaaagcatccgtgataatgaaaaggcaaagaaacgtcaatttgttattgatgttggtattactcgtggccgtcggtcagatggcgcaaaccatttatattccagctattgccgatatggcgcgcgatctcaacgtccgtgaaggggcggtgcagagcgtaatgggcgcttatctgctgacttacggtgtctcacagctgttttatggcccgatttccgaccgcgtgggccgccgaccggtgatcctcgtcggaatgtccatttttatgctggcaacgctggtcgcggtcacgacctccagtttgacggtgttgattgccgccagcgcgatgcaggggatgggcaccggcgttggcggcgtaatggcgcgtactttgccgcgagatttatatgaacggacacagttgcgccatgctaacagcctgttaaacatggggattctcgtcagtccgttgctcgcaccgctaatcggcggtctgctggatacgatgtggaactggcgcgcctgttatctctttttgttggttctttgtgctggtgtgaccttcagtatggcccgctggatgccggaaacgcgtccggtcgatgcaccgcgcacgcgcctgcttaccagttataaaacgcttttcggtaacagcggttttaactgttatttgctgatgctgattggcggtctggccgggattgccgcctttgaagcctgctccggcgtgctgatgggcgcggtgttagggctgagcagtatgacggtcagtattttgtttattctgccgattccggcagcgttttttggcgcatggtttgccggacgtcccaataaacgcttctccacgttaatgtggcagtcggttatctgctgcctgctggctggcttgctgatgtggatccccgactggtttggcgtgatgaatgtctggacgctgctcgttcccgccgcgctgttctttttcggtgccgggatgctgtttccgctggcgaccagcggcgcgatggagccgttccccttcctggcgggcacggctggcgcgctggtcggcggtctgcaaaacattggttccggcgtgctggcgtcgctctctgcgatgttgccgcaaaccggtcagggtagcctggggttattgatgaccttaatgggattgttgatcgtgctgtgctggctgccgctggcgacgcggatgtcgcatcaggggcagcccgtttaagcgcacgtcaccgcagcatcgtcatcagctccatgggagaacgatgctgctttatcagatcacgcatcacccgcatatgcggtgcggagtaagaataaaacgcctgatagcccgcacaaagcacgctgtctggcgtctcctgccgagcgtgcgggcacaggcgatgccagtcgcacgcctggcagtcacggcgcggttgcgggttttcgctgccacaccatttttgtaaggtggcgtcaaaaagctcaatcgagatacgactgatatctgcccgcacccaacactcgaacagggcaattaaaaatttcccccacagctctgctgtcaccgaagcggccgtcagatcgccccggtcatcaaattcaagatagggaatgagctgtacggagcggatgccccgctgtttgaaattgtgataaaaatcggcaggttgcagagcatccttgtactctacaaccagtttatgcctgtcctcttcagcatcaatgacctgacttcctgtcatgcgactctctcaataaatacgataagttgatgtatatgcgttacagcaaacagtattgcgagagataacaccgcgagggagatcaaaaatttgtcacggactacgtgaaattgggaaaaatcgctattcgtgacatccattaaattgcgattacgggtgtagtgccagaggatcagcgccacgatggcgagaatgccaatcgaaatccagaataacatgcccgcctggtgccagttgtgtttgatagccaacgccatcaacgcgccgtagcccagcatggtacgaaaccacgccagtgatgtgcgctccggctgcagtcctgggtcggcaatgcgtctggctttgcggctatccggcatacaacaccagtcccataacgatcaccgccacgaccatcaatattaagctaatgattaataagctgttggtgtagggcaggtcctctttcagacgcatcgctttttcattgcgtaaccagcgcaagtagccatacatcgctaacccgccggaaaacagacacaacaacaacgccagcagttcgcgaatgacgggcgtggcgaaatctggcgcaagttgatcaagcccaacccccgccgccagaaatcctagtgcagtacggatccacgccagaaaagtacgctcattagccagcgagaagcggtaatcaggcgcttctccgaggcgggaaattttcattgttgctcctttgcaatttcactaacgctctacctttagcggtttttttaagaatttcgtccgcccgtttcctgatatgcttttgccatccgctacaaggaggtcagatgggtatcatagcgcaaattgacatcctccacgccctgaaggacgtggatccctgctacgttcaggctgtcgcctgaatcatttcggtgggttcctgcttcaacgggcggcctgactgcaccatctctccacaggcaagaacggcgtgccccgccgctaaaatgttacgagcgccatttacatcggcgttcgctgtatatccacatacctggcatctgaatttactttgtgacaggcggttctctttcgctgtatgaccacagtacgcgcaacgctggcttgtatacgctggcggaacagcaagcacctgaccgccacgccagagctgcttgtactcaagctggcggtgcatttcataccagccctgatccagtatcgaacggtttaaacctgattttgcccggacattgcgccccggctggctgaccgtacccgctgctgactttgacatgttgctgaccttcaaatcctcaatgactatcattgcgtggtttttgctgacggccgttgtgactttgtgaaggtagtccctgcggatatttgcgatacaggaatgcagtcgctgtattttgcgtttctgcttctgccagttgttgctgaatttgaccttgcggcttaactgtcgctgaagtctcgctagcgtcttctggtttttctgaaaactgtttacaggctcaaagactgtgccatctgacagcgtggcgagtttagccacgccagcatccagcctgaccattgatgctgaagggtgagccggagtggatacttcactttctgtctgaatactgatgtaccacttaccgcaggactggctgacagtgacatttttcacaacacccgtgacctgacggctattccggtagcgcatccagcccagtttcggcagaaaaatacggctgttttcctgatcgagcttaacgccctgcgggtagcggaatgcatcattctgtccccgctttttgaatcggggaaaagcagcccgcttccggaagaagtttttgtaagcccgctcaaggtctttcagtgactgttgcaatggctgtgagggagaatctttaagccattgcgtttcagtggcatttttccactcaaccagccaggaagccattttcccgtaagggatgtatttattaccggcctcatgattctcattctgacgtgccagagcacgattgaaaacgaaacgacatgcgcctgcgaagcgcctcatttcacactcctgttgaccacctggtcttaactggaatttaaatgcctgtaatcgtttcacaggccaaatgatactttggtctatgaataaagaaaccgatatccgacggggaaggcattgtgttttcctgatgcatgttcacctggtctttgtcaccagataccgacgtcagatttttgaccatgacgcgacagaaaaactacgcgcttacttttcaaatgtatgtgctgattttgaagctgaactggttgaaatggatggcgaaccagatcacgtccatttgttaattaactatcctcccaaactggcgatatccagtctggtaaacagcctcaaaggcgtatcgggtaggtgactgcgacgagatcgaccagatattgcagtcaggtattactacaaaggcgttttgtggagtcctggctattttgccagtagctgcggaggtgcgccaatatccgtcatccgccaatacgttgaacaacagcaaacacctggtcaggtggaaaaccgcgccttatatccccgccctgaaggacggggttttacggcgcaccggataaatttggttatgcgccgtcagccgtgctaaagaatacggaccagcacccaacggatgccagttcacacaattaacgtaactctggccagtacgctttgttggcctccagcaactcatccagaatagctttggcgaccgaggcgctcggtaccgttttcgataacgtaatcgcctgccacaggtgctgatatgaacgctgttcccaggcgtccacgaccagtttttccaccgccacttgctgactcattaaccctttctgaaactgcgggatatcgccgaccaccagtggttctggtccgttgtgcccgaccagacacgggattttgaccatcgcttcatcatcaaagttatgaattgccccgttgttaggcacaatcagcaacatccgctcctgagtgttgaaggcaattgccgccgccagatcgacgatgtatgacgcatgttcgtcaatttccagcttgcccgccgctgaatttcctgccgccgtaatggcgcggcaagcatcgaaaacctgtttctcgcgatgttccatcacctcattcgcgcgggtatgttcagggttggaatgctgaacgacataatccgggaagagataatatttcagataggtgtttggtaatgtatccgggtccagtgcctggacatcccgcgcttttgcataggtgtcgttccagctcgcttcagtatgtgtatcttgcagcggtggaacataaccgtgcttagagacatattgccgcagctggggcatcaggtcgttgccctgcaaatcttcaattgatgtccaccagccaaagtggttcaggccgtagtagcgcacgcgcatctgtttgcgatcttgcagcccaacaatttgcgccatccggctttcaataccgattggcatgtcacagatgttgaggattttcgcattcgggcgcagacgacgcgtggcttctgcgacaattgctgccgggttggagtagttgagcatccaggcgtttggtgaatatttttccatataatccaccagttccaggacgccgccaatggaacgcatgccgtacgctattccgccgggtccgcaagtttcctgaccaacaacaccgtggcgcagtgggattttttcatccagttcgcgcatcgggtacttgccgacgcggatgtgcgccatgacaaaatcaacgtcgctgaatgccacttcaggatcggtggtgtaactaaacgcaatgtccggcgctttctctttaaggatgactttacaggcttcggcaatcacttcctgccgcgcaccatcgttatcataaaatttcagtgcacgaagcgggaaacggtcctgattcgccaggagcatcaacacgatgcctggcgtaaaggtgcttccaccgcctgcgacaaccactgagaatttggtcattatactgcctccgtaatggcaacattttctgctgattgatgagaattaattaagctatcgagctgttcacgcagctgggatacatgcagaccaatgatcacctgaatggcatcgccactacggaagacgccgtgcgctcccagctttttaaagacttcgtcatccagcgtttgtgacatgtcatgcagtgcaatacgtaaacgcgtcgcgcaattgttaatgctggagatattgccgaccccgcccagggcttgcaggataccggcagcctgatccagctctttttttggctctgccgcggtggtttggcctcgcgaggctttgtattcggcttttgagtagagtttcacttccgcatcttcacgtcccggcgtgcacatgttgaactgcagaatcagtgtgcggaaaaccacgaagtacagcagggtaaagcacaacccaatggcgatttgggtcagcatcatatccgcgtggttgctgaacatcgggatccagttttgcggtaaaacctggtcaatcagacctccgcccatgttgcccaccacaccaaagagatacattacggtcgacattgaggccgccagcacggcgtgtaccgcaaacagcaacggtgaaatgaacaggaaggtaaattccagcggttcggtaattcccaccagcatggcggttaaggttgcgggaatcagcaagcccgccacttttacccgattttccggtgcggcagtgaagtacatcgctaaagaaatgcccacggcaccaaagatttttgagttaccgtgcagggcaaaaccgccttccgggaacaacgatttcagcggctcggcgctcaaactgaactcttgcagatgctgcgcccagtacatctgaatgccgccttcaacagctgccggaccaaagataaactgtccgtagatgaagtggtgtaaaccggttgggatcagaatacgttcgaggaaggtgtaaacccagaccccaagtgcacccgccgaacgcaggaacgcttgcagagattcaatccccatttgtacttttggccagccgagcaacgtcagccaggcacaggggatcatcaccaggaaggcgataatcaccacataagacgtcccctggaaaatgccgagaaaaaccggcagttttttatcgaacagacggttatgcagcgccgtcacaatgccggaaatgataattgcgccgataatgctggtatcgagggttttaatcccggccatcattgtcagaccgctacctgccaccgcgtcctgagtgaaatcgacgccgaagtagcttccccaggtcattcccatcgcgttgatgaaatagttccaggtcaggaaactcaccatcaccgccagacaagcacgcccctgcgcttgcttagcaaggccaatgggtaaaccgacagcaaaaatcagcggcatattacggaataccgtccaaccgccctcttcaataatgtgtacgatttgcgcgaataaactgttcggatcggtcagtgattccccgacaaacatcgggttttgcagcaagatggcaagacccaccacaatcccggcgaagggaaacagcagcactggcgtgaacatcgcgccgccaaagcgttgaatttgactgagcatttccacatcctcttttctcaattctgtaagtaggaagcctgattggttatgcggcaggcctggagcgaggataggaagatgcgatcggcagaacatgacgacccaatgggattcgtgatcgctttcatgcttttcgttgggcggtagagatctacgttttcgcgaaaaagtagacatctgtgagcactggtacacagcatcgaacacatctttaaaaaaaagatgttttttcaatcgattaagcagaacttgtgggcgcattacccgggcttgcaggcaaaaaagagatctagagatgatctacaaaagcattgcggagcggttaagaattcgacttaattccgcagatttcacgctaaacagccttcttcccggtgaaaaaaagttggcggaagaatttgcggtatcgcggatgaccatccgtaaagcgattgacctgctggtagcgtgggggttggtggtccgccgccacggcagcggcacttacctggtgcgcaaagatgtactgcatcaaaccgccagcctgaccgggctggtggaggtgttaaaacggcagggaaaaacggtcaccagccaggtgctgatttttgaaatcatgcctgcgcctccggccattgccagccagttacggattcaaatcaacgagcagatctacttctcccgtcgcgttcgttttgtggaagggaaaccgctgatgctggaagacagctatatgccggtaaaactgttccgtaatctttcgctgcaacatctggaagggtcgaagtttgaatatattgaacaagagtgcgggattttgattggcggtaattatgaaagcctgatgccggtgctcgccgatagactgctggcgcggcaaatgaaggtagcggaacacacgccactgctgcggatcacctcgttgtcatatagcgagagcggggagtttttgaattattcagtaatgttcagaaatgccaacgaataccaggtggagtaccatttacggcgactccacccggaaaagagttaaccgatactccagaagagcaccgccagtaattggggggtgataatgcgcaggaacatcactaacggatagacagtggcgtaagagagcgccgctgcaccgctggttggatgaagattattagcaaatgccagcgccggtggatcggtcatggagccagccagcatcccgcacatggtcaggtaattcattttggctaacatccgcgccagaataccaacagtaatcagcggaacggcggtgatcagggcaccataaccaatccagcttagcccttcgccattgaccagggtattcacaaaatccccaccagatttcagaccaacgaccgagaggaacagcacgatccccagctcccgcagcgcgaggttggcacttggcggcataaaccagtacagcttgccaatactgccgatacgcccgaggatcaacgccataatcagcggaccgcccgccagccccagtttcaacgcggccgggaatcccggcacaaagacgggaatagagcctaacaatacgccaagcccgataccaataaacaccggcaacatctgaacctgttgcagtttttgctgcgcattccccagcacattggcaacggcatcaattgcggacggacgccccaccaggttgagaatatcgccgaactgcaggctgatatcgccactggcgaccagttcgaccccggcacggttcaggcgcgagataacaacgtcatagcgttctttaaagtgcaggtcgcgaatacgttttccgagcacgttttcattggtgaccaccacacgctcgacgcgcaaatcagtgcctttcgtagacagcgaggtatcgacctcctgaccaatcaccagttgcgcattatgtaaatccgctggctgccccaccagatgcagcaaatcgcccagttggataatggtatctggcgaaggaacttttagggtttcttcacgtttcagacgcgagcagataattttgtcgccgttgagaataggtacatctttaatggctaaatcatgcaggttagggttctcaacgcgaatattgatagtcctgatcagcgcgccgccattggtgcgtgaagactcgtgctgctgggcttctgtctcgacattgacgcggaaaataacccgcaacatccacatggtgaacaatatcccgcaaatgccgaatggatacgccatcgcataactcatccccatctgatcgaccatttccattggtgtacccaggtcgcgcaagatctgctgccctgcccccagcgctggcgtattggttaccgcaccggagaaaatccccagcactaccggcagtggaatatcaaacagtttatgcaggatggcggtaaccagaccaccgatgatgacgatcagaacagcaaacaggttgaggcgtaatccggagacgcgcaatgaggcaaagaagcccggacccacctgaatcccgatggtataaacgaacaggatcaggccaaattcctgaataacatgcagcatatcgctacttaatgtcattcccgcctgagaaacaaaatggccgacgatgatcccaccaaacagcacgccgccaatacctaatcctatgccgcgaaatttgacgttgccgataaacaaaccgacgactgccaccaaagccagaatactgaccgttaatgctatatcactcatcgtccatttctcttgagataacattttaattgctacggattatggctgaatcggtgaagcagatttgccttatagcgcacattatcacgggaaagaacgtgccgaaatatcttaaacagtcgaaatttaacgcattgttgaagaagaaagacaaaaaaagccccaccagaatggcggggcaaagagaatagctagttagctatttaacgcgggacgttcgctgatagcgatacgctgcgctgcgatgggttcaggctcgttacgaattaaatcaatatgcagtaaaccgtttacgaaggttgcgccagagacttccatattttcagccagcgtaaaactcaggctaaatggctgattcataagcccttgatgcagccattttttctcttcttttggctgctccggcgtgccttttacgctcaggcgcgtaccttccagttgaatctctaaatcttcctgacggaaacctgccaacgcaagggtaatgcggtagtggttatcgtcgcttttctcaatgttgtacggcgggaagctctggctttcaccggcgttttgcagtgcgttggccagtttgtcaaaaccgatccattgacgcatcagtggggataaatcgaagttacgcatagtcatttctccttctaagaagcgagtaagtacctgcaaatccgaagattcgcatatgctccctgacggcgagcatggagatgtcaggccgcgccaggcggccttagggaattagttgatttcgatacggcgcggttttttcgcttccggaatcacgcgttcgagatcgatatacagcaaaccatttaccaggttagcgccacgaacatgaatgttctcagctaactggaatttgcgttcaaagttgcgttcagcgatgccctggtacagataggtgcgctctttttgttcgtcggcgtgagcacctttcaccaccagcagattatcctgggcggtaatttccagttcgctctcagcaaaaccagccacagcgatagcaatgcggtaatggttttcgtctaccagttcaacgttatacggagggtagccgccattactctggctctggttgttttctaagtggttaaacaaacggtcaaatccaatagcagaacggtaaagcggggataaatcaaagttacgcataatcaatagctcctgaaatcagcgagaatgtaagaccttccacaatggacaggtcaggtagccagaacacccatcaggcgcgtcctcatcggctacgatgtaaaaatgggtctggaaatgaacttttcaagccttatcagcggacttttttttgcagtttatggtctattgcatagactgagggggcagcacgaaacgttaaagtgcgattgccgccacagagcgacgtaatgatgatgttattttcagcaagggatcgctataactcatcaggccaacacccacgatcaacagatgaatttattatgataagaaatgtgttgttagcgttcatgatatgcagcggaatgacattactcggaggatgctccagcgtgatgtcccataccggggggaaagaaggaacgtatcccggcacccgcgccagcgccaccatgattggcgacgatgaaaccaactggggcactaagtcgctggcgatcctcgatatgccgtttaccgctgtgatggacacgcttttactgccgtgggatgtgttccgcaaagacagctcggtgcgctcgcgcgttgaaaaaagcgaagccaacgcgcaagccaccaatgcggttattccaccggccagaatgcctgataactgatttagcgatcagtttcggtgatccacagctggccaccttccatccacgccagccattgaccatccggtgagaagaccacggcatccgcagaaggcggattggcgtggttttcggttaaatactcaacctcgccactttgcgcatgggcacaagcaattcgattatccagcacaaagcccaaccattctcctgacggatgccagttaaatgcagactgaatatccgttttgttatgggttaactggcgcggctcgccgccctgtggcgagataagccacagttgcacaatgccgttatcatcacgcattaaaaacgcgatttgcgtaccctgcggattacagcgcacccagtggcgcgggacgttgactaaccccggataagcccgatggtgggtaaaggttaaacgtcgctgcacgacgccacgcggtggcgcgggcagggttgtttccgttccgcttaacggcgcatcacctgccgctttccagccagcttcatcttgcggtaactcaacgataaacagctccggcactttctcgccctttggcgaaagtgtgtcgccaataaatgccagcgcgtgatttcctacccatccttcttcataagcacgattgatttcatcactgccaggctgtggcgtgggcgtggttttgctcaccagcacgcaccagtggctaccgctgtattcacgcggatgctgcttttgtacgttgaccgggccaaacggcgcagcaacaccgacgtttcgcaaatccagcgccggatcgagttcttgcattacatggtcgttataggtaaagctcaccctttcaccgttcgggctaaagacatgcacatggctgccgccgcgcagcgctcctggggtgtacggtgcagtaatatccattgcatcgagattgctcaccttgccgctttcagcaatcacgccgcgacggtgatggaaatcgtaataccatgtttcatcaggattttccgggccgtgaataaagacatatttctctgactttggatgaacggtcaccacgccgacgtgtgcgccctgtgacgcgcgatagataacctcgacctcgccggtatggatattcacacgctcaatggtctcgccggtaaacgacgcgccagaaggacgcacgtcaaataccagccactggctgtcgggcgtccaggtattggtattggtgagcaggtgattacggggagcaaaggttatctgtttcatggcgcggtcctgatacaaaacgggtcccgccatcatacttcacaaggacttcactttcagacaatagtcttttgccatcgtgatgaatgtgagtgaaaagatggaacatttcgacgtggcgattattggcctcggcccggcagggtcggcgttggcacgaaagttagccggcaaaatgcaggtgatcgcgctggataaaaagcaccagtgtggtactgaaggtttcagcaaaccttgtggcggtctgctggcaccggacgcgcagcgttcttttattcgcgatggactgacgctccctgtcgatgtgatcgccaatccgcagattttcagcgtcaaaaccgtcgacgtcgccgcatcgctcacacgtaactaccagcgaagctatatcaatattaatcgccacgctttcgacttgtggatgaaatcactgatccccgccagcgttgaggtttaccacgatagcctgtgccggaaaatctggcgtgaggatgataaatggcatgtcatttttcgtgcagacggttgggagcagcatatttccgcccgctatctggtcggtgccgatggtgccaactcgatggtgcggcgacatctctacccggatcatcaaatccgtaaatatgtcgctatccagcagtggtttgcagagaaacatccggtaccgttctactcctgcatctttgataatgaaataactgactgttattcatggagtatcagcaaagacggttattttatctttggcggtgcttatccaatgaaagacggtcagacgcgtttcacgacgctgaaagagaaaatgagcgcctttcagttccagtttggtaaggcggtgaaaagcgaaaaatgcacggtgctgtttccctcgcgctggcaggattttgtctgcggtaaggacaacgcctttctgattggcgaagcggcaggatttatcagcgccagctcgctggaggggattagctatgcgctggatagcgcagagattctgcgtgcggtgttactgaagcagccggagaagagcaacgccgcctactggcgcgccacccgcaaactgcgtttaaaactcttcggcaagatagtaaaaagccgatgcctgaccgcaccggctttaagaaagtggattatgcgcagtggtgtggcgcatattccacagttgaaagattatccaacgcgcttcacatcgcccaccagcaggatgtaagagagcgcgccaatcaacgcgacggcggagatataaaccagtgcaggtgcgaaaccgtaaccctgcgccaggtaccccaccaccagcggaacggtgatgccgcccagaccaccggcgaagttaaacacgccgccggttaaaccaatcaggcgcatcggtgccagagaagagaccagcgaccaggtaatcgaagcaaaaccgttgccgaagaatgccagcgccatcaggcacataatcatcatcggatcgttagtgtagttagcgcccataatgcaggtggagatcagcaagccgcagataatcggcgttttacgcgcaaagcccagtgaaaagcccttacgtaccagcagatccgcgacccagccagagagcaggacgccgacaaacgccgcgaggaatggcaccgtggtcataaagcctgctttcagcgccgtgattcctttttcctgggttaaatagttcgggaaccaggttaagaaaaaccacagtgtagaagccaccgcaaattgcccaagatagacgccgatcagtttacgatgaaacaccagtttccagtctttggctgttaacggctgacgtgcctcttttttcaccggcgcatcgccatccaccagaccgccgccatcacgaatgtaatccagttcagctttgctgatacctttggtcaggcgcggcggctgataaaccttaaaccaaatcagcgaccagataatgccgataccaccggtgacaatgaacacccagtgccagctcaacatctcctgaatccagatcagcagcggagtcagaaacgccagaccgacaaactgaccagacgtataaaaaccaacggcagaagcgcgttcatgttccgggaaccagctggtcaccatccggttattggtcgggaaagcgggcgcttcgaaaataccggttatcgcgcgcagaccaattaatgacattaatcccgtggcaaagccctggaataaagtcgccactgaccagccaaatatcgcaataaaataagtcacgcgagaacctacgcgatctaaaaaccaaccgccggggatctgacatagcgtataaagccaggcgaaggccgaaaatacatagcccatttccgctttggtaataccgaactcttcctgaatatgggcggaagccacggccaggttagcgcggtcaacataacaaatgaccaccgtaataaagatcatcaccagcgtcagataacgccgacgccccggctttgctgcattaacgggaatatccatagcgagctttctccagattttgggcatagcgaagccgctcaccatgccctgtaatttacagagggttatatttttgtattgctgttttagtgcccgatgaggggcttacgtggcaggaattaccactctgctacgctgttatcttcatgacgccagagcggattacgccagtccggggcatttttactgaactcaataactttagcttcgtcgatttccacgcctaagcccggtttcgttagcggtttaaagaagccgccaaccatgctgaagtcctctttgtttttcacaaagtcgagtaactccgcgcctttgttgtaatgaatgcccatactttgttcctgaagtacggcgttataggaaacaaagtcgatatgcaggcaagccgccagtgcaatcggtccgagcggacagtgcggcgcaagggtcacatcataggcttctgccattccggcaattttgtagcattcagtaataccgcctgcatgggagagatccggttgcagaatcgaaataccgcctgcctccagcacgcgtttaaaatcgaagcgtgagaacatgcgctcacccgccgccagtggaatatgcgtttgtgccgccagtttcgggtagtattcggcttgttctgccagcaccggctcttcaataaacagcgggcgatacggctccagttctttaatcagcactttcgccatcggcgcgctgacgcgaccgtggaaatcaagaccaaactcaatctgattgccaaaagcttcacgaatttgtgccacggtgttgactgccgcatctaccgcgcgggagttatcaattagccccagttcttcacaaccgttcagtttgaaggtatcgaagccgatttcgcgcagggttttaatgccgccgataacatccgccggacgatcgccgccgacccaactgtaggctttaattttgtcgcgaaccaggccgcccatcagttgccagaccggcgcattcagcactttacctttgatatcccataacgcctggtcaatcccggcgatggcgctcatcaggatcggaccgccgcgatagaatccggcgcgatacatcacttgccataagtcattgatgcgcgatggatcctgaccaatcaaatagtcacccagctcgtgaactgccgcttccaccgtacgggcgcggccttcgatcacgggctcgccccaaccgaccacgccttcatcggtttcaattttcaggaacatccagcggggaggtaaacgatacgtggtaattttggtgattttcattgcactgcctctcgatacgccttaacaaatgctgctgcctgctgcgcggtgcgctctacggattgcccggcgcgatagagatcgctgcctaagcccgcccctgcacaacctgcgtctatccactgcgccaggttttctggcgtcacgccgccaacggcaaagactgcgatgtccgatggcaataccgcttttaacgctttgatgtattgcggaccaaaagccgatgacggaaatattttcagcgcctgcgcgcccgcttcgagcgcggtaaaggcttcggtcgccgtcgcgcagccggggcagacggtcatgccgtagcccaccgcacggcggatcacttcactatggatattgggcgtaacgatgagctgacagcccatcctggcgagcgcatcgacctgttcaggtttcagtaccgtacctgcgccaatcaacgccttgtcgccgtacgcatcaacgatggcgggaatgctttgctcccattgtggggaattcagcgggatttcaaccgcgtcgaacccggcgtcaatcaccgcgccaacatgcgccagcgcctcgtcgggcgtaataccgcgcaaaatggcgatcagcgggagtttagtttgccactgcatgagcgatgctccttataccagcctgaaatgccgtgtcgcccgccaccgccgtcacgtcgcaacccatcgcctgaaaggcttgctggtagcgcgcggtcagcgatgttccggcgacaagggtgatggcgtgttgatgggccacatagtcgcgcatactggcgacctctgcgccaatcaacaaaccagagagaaattcgctgacctgttcgcggggaagtgttcccagcacatgcgaggcgcgaactccaaaaagctgcggcaatatggcgggcgtattaagaccacgctcaaggccagctgtgaaggcatcggcagagttttcctgcggcggcaaacctgcgccaatcaatgagtgatttaacagtaaatgatgtaattcaccggtcatcacggtgcgaaaatcgttgatttgctggctatcggcctgcacccatttgcaatgagttccgggcatgacataaagagaggaaggagccagagctcgcgcgccgatcaattgtgtttcttcgccgcgcatcacattgtggttatcgtcatgagagacacataatccgggaataatccagatattgtcgccaactgacgttaattgttcgccaatagacgaaaaacaggcaggaacagataaatacggtgcaactttccagccgacgttgctgccaaccattcctgccattaccactggcgttttctcttcacgccagtcggtcgtgacttctgctaacaccgcagccggagattttccgttcaggcgcgtgacgcctgcttctgattgcctgctctccaggcagtggtcgccctgataaagccaggcgcgcagattggtcgatccccagtcaattgcgatgtagcgagctgtcatgtgatttcctttaaccttcgtgtcgagctggcgatcatggtaagcgccgcctgctctgccgcatcgccgtcctgatgtcgtatcgcatcgaacagcgccttatgttcctggagcgtttgcggcatgttggcctcatcgcccatccaggttcgttcaaaaaccgcccgctgcagcgaactgatcgcaatgctaagttgctgtaacaccgggttatgcaccgactgcagcaccgcctcgtggtagcgaatatccgcttcgttaaacgcttcgcggtcctgattgttggcaatcatctcgttcagcgccgattcaatctgcgccagatcgctggaagtcgcgcgctctgctgcccaacgggcaatcgccggttccaccagatttcgcacttcgctcatggcactgataagccgtgggtcgtagtcattttccagcacccattgcagtacgtcagtgtcgaggtaattccactggttacgcggtgccacaaacgccccgcgataacgtttcatttcaatcagccgcttcgccatcagcgaacggaacacctcacggatgatgttgcgcgaggttgcaaactcctcacagagttccgcctcagccggaagcggcgagcctggcacgtatttgccgtgaacgatctgtttacccagcgtaatgacaatgcgatcggttttattgagagtcatggagagtccttgtgctctgtatgttcttctctactttaccccgatcgatgcataacgcggcaactttgtagtaccagcgtgatgacgttcgcgtttgccgtgcgtgtaatgtagtacaaacttatattgttgtactacaatttagatcacaaaaagaacaatgcataaaaaaatgacatgcgtcgggcagaaatctgaaaagggatatcaggcgctaaacaggagggaaagaagagtatgctttcaacggcttagctactcgtttaaaggattaatcatgaagttgaattttaagggattttttaaggctgccggtttattcccactggcgctgatgctttcaggctgtatctcgtatgctctggtttcccataccgcaaagggtagttcaggaaagtatcaatcgcagtcagacaccatcactgggctatcgcaggcaaaagatagtaatggaacaaaaggctatgtttttgtaggggaatcgctggattaccttatcactgatggtgccgatgacatcgttaagatgctcaatgatccagcacttaaccggcacaatattcaggttgccgatgacgcaagatttgttttaaatgcggggaaaaagaaatttaccggcacaatatcgctttactactactggaataacgaagaagaaaaggcactggcaacgcattatggttttgcctgtggtgttcaacactgtaccaggtcactggaaaacctaaaaggcacaatccatgagaaaaataaaaacatggattactcaaaggtgatggcgttctaccatccatttaaagtgcgattttatgaatactattcacccagaggcattccggatggtgtttccgcagcattactgccagtgactgttacgctggacatcattactgcaccgctgcaatttctggttgtatatgcagtaaaccaataatcagtaagcgggcaaacgcgtttatgctgtttgcccgcccacagattaattcagcacatacttctcaatagcaaacgccacgccatcttcaaggttagatttggtgacaaagttcgccacttctttcactgaaggaatagcgttatccatcgccacaccgacgcctgcatattcaatcattgcgatatcgttttcctgatcgccaatcgccatgatttcttccggtttaatacctaacacgtcggccagtgatttcacccccgtacctttgttaacgcgtttatcgaggatttcgaggaagtacggcgcacttttcagcacggtatatttctctttcacttcctgcggaatacgcgcgatagcctggtcgaggatggcgggttcatcaatcatcatcactttcaggaactgggtattggggtccattttctccgcttcgcagaacaccagcggaattgtggcaacgaaggattcatgcaccgtgtagtagctgatatcacggttggcggtgtacagcgtggtgcggtccagggcgtggaaatgagaaccgacttcgcgagagagtttttccaggaaacggtagtcgtcatagctgagagcggtttgcgccacggtgctaccatcagcggccttctgtaccagcgcgccgttataagtaatgcagtagtcgcccggcagttccatatgcagctctttcaggtaattgtgaacacctgcataagggcgacccgtcgttagcacgacattcacgccacgggcgcgagctgcggcaatcgcatttttaacggcgggtgaaatggtgtgatcgggtagcagaagggtgccatccatatcgatagcaatgagtttgatagccatgagttccccaggtagattagttcctgacccatgctaacgcgattccgctcaaaaatcagtacaacacccgagggaaaagggggatgcaacgcgggttgcatgctccccatttgcttagcggaagagtttccctttcagcagttccatgcctgcggaaagcagatcgttattggcttgtggagacacttcaccttgcggtgagagcgcatcaataatcttcggcaattgttctgccagtaaactggaagctgtactggtatccacgccaagtttttgtccaagatcggacaccgcatttgtgccgagcgccgattccagttgctcgccactaaccgattgattgccctgttgattactcagccaggttgagagaatggcccctaagccgccactttgcagtttttccagcagcacctgaatgccgccctgctcctcaacccaacttaaaatagcctgatatttccccgcatcgcctttcagaaaggcaccgacaacttcatcaaaaagccccatgataatcacctgtaaagcgttacgtgttgacccaaaaagtatagatttgcgggatgataattgcggattgcagaaataaaaagggcggagatgatctccgcccttttcttatagcttcttgccggatgcggcgtgaacgccttatccggcctacaaaatcatgaaaattcaatacattgcaagattttcgtaggcctgataagcgtagcgcatcaggcacgctcgcatggttagcgccattaaatatcgatattcgccgctttcagggcgttctcttcaataaacgcacggcgcggttcaacggcgtcgcccatcagcgtggtgaacaactggtcagcggcaatcgcatccttaacggtaacgcgcagcatacgacggctttccgggtccatggtggtttcccacagctgttccgggttcatctcgcccagacctttataacgctggatggagaggccgcgacgggactctttcaccagccagtccagcgcctgctcgaagctggctaccggctgacgacgctcgccacgttcgataaacgcatcttcttccagcaagccacgcagtttctcacccagcgtgcagatacgacgatattcgccaccggtgataaactcgtgatccagcggatagtcagtatccacaccgtgggtacgcacgcgaacaatcggctcgaacaggttttgttcggcattggtgtggacatcaaacttccactggctgccgtgctgttctttgtcgttcagttcgctgaccagcgcgttcacccagcgggtaacggtctgctcatcagagaggtcggcttccgtcagcgtcggctgatagataagctctttcagcattgctttcggataacgacgctccatgcggttgatcattttctgcgtcgcgttgtactcagataccagtttctctaacgcttcgccagccaatgccggtgcactggcgttggtgtgcagcgttgcgccgtccagcgcgatagagatctggtactgatccatcgcttcgtcgtctttaatgtactgttcctgcttgcctttcttcactttgtacagcggcggctgagcgatgtagacgtgaccgcgttcaacgatttccggcatctgacgatagaagaaggtcaacagcagcgtacgaatgtgcgagccgtcgacgtccgcatcggtcatgatgatgatgctgtgataacgcagtttgtccgggttgtactcgtcacgaccgataccacagccaagcgcggtgataagcgtcgccacttcctgagaagagagcatcttatcgaagcgcgctttctcgacgttgaggattttacccttcagcggcagaatcgcctggttcttgcggttacgcccctgcttcgcagagccgcccgcggagtccccttccaccaggtacagttcggaaagcgccggatcgcgttcttggcagtctgccagtttgcccggcaggcccgctaagtcgagcgcacctttacggcgggtcatttcacgcgcgcgacgcgcagcttcacgggcacgggcagcatcgataattttgccaactacgattttcgcgtcggttgggttttccagcaggtattctgccagcagttcgttcatctgctgttcaaccgccgatttcacctcagaagaaaccagtttgtctttggtctgggaggagaatttcgggtccggcactttcacggaaacgaccgcaatcaggccttcacgcgcatcgtcaccggtggcgctgactttggcttttttgctgtagccttctttgtccatgtaggcgttcagggtacgggtcatcgccgcacggaagcctgccaggtgagtaccgccgtcacgctgcggaatgttgttggtaaagcagtagatgttttcctggaagccatcgttccactgcaacgccacttcgacgccaataccgtctttttcggtggagaagtagaagatattcggatggatcggcgttttgttcttgttcagatattcaacgaacgccttgatgccgccttcatagtggaagtggtcttctttgccgtcacgcttgtcgcgcagacgaatggaaacgccggagttgaggaacgacaactcacgcagacgtttcgccagaatttcatattcgaactcggtcacattggtgaaggtttcgaggctgggccagaaacgcaccatggtgccggttttttcagtctcgccggtaaccgccagcggagcctgcggtacaccgtgttcgtagatctgacggtgaattttaccctcgcgctggataaccagctccagtttttgcgacagggcgtttactaccgaaacaccaacgccgtgcagaccgccggacactttataggagttatcgtcaaatttaccgcctgcgtgcagaacggtcatgatcacttccgccgccgatacgccctcttccgggtgaataccggtcggaatgccgcgcccgtcatcctgtacagagacagagttatcggcgtgaatggtgacgataatttctttacagtgacccgcgagcgcttcgtcgatagcgttatctaccacctcgaataccatgtggtgcagaccggtgccgtcatccgtgtcgccgatatacatacccgggcgcttacgcaccgcatccagccctttcaggactttgatactggaggagtcataagaattcgacatcaacgtttctcgctcatttatacttgggttaatccgttattttacccttttccacggtaaacatcttcgaattttcgtccgacatgtctataacgtgttcagcactgatcgcgctgacaaagacctgtgattgcgtcgcttttaagcggctggcaagcagcccgcgacgctcatcatcaagctcagaggcaaaatcatctatcaggtagagacaccgccgcccgctttcacgggtgaggaactctccttgcgccagacgtaaggcgcacatcaacagcttaagctgcccacgcgataaggtatcttccaccggcgcaccgtcggcgcgaatgcgtaagtccgctttatgcgggccatgcgcggtgtaggttagctggcgatcgcgttcaaaattacgttccagcacctcagcatattctgtctctttctcccagccgcgctggaaagagaaagtcagagaaaactcagggagaaattgcttacaagtatcggccatatcagccgcgataccggcgctatactccgcgcgccaggtgctgatttgctccgccagcgggatcagctctttatcccacgggcgtagctgttcgtaacgtgtcacctggcgcagcgccgcattgcgctgcttgagcaatcgcttgagattgctccaggcggtgaaaaatccgggttcgttgtgaaagcatccccagtcgaggaatgctcttctgtatttggggccgccgttgagtaaagtaaacccttctggcgttatcaactgcattggcatcaggtgcgccagttccgcgaccttatgcccgtctgtaccgtcgatgcggactttgctgtcgccctgtttgtctttggttaagccaatcgctgtctcgcgctcttcgccctgtaatcgcccgtggagaacaaacgcctcctgctcatggcgaatgacgcgaccaatctgcaaactgcgaaacgcccgaccatggccgagcgtatagatggcttccagcacgctggttttgccactgccgttggcacctaccagaaagttaaagccgggagataaggcgagatccgcggtttcaatgttgcggaaatcgcggatcaacaagcgggtgagggacattacagtctcattggcatgacaacataagccgcgctctggctggccgcatcttcaatctgcacgctggaaaccgaatcggtcagcatcatgcggacgttttcgcatttcagcgcgttcagaacatccagcacataactgacgttgaagccgatttccatctccgcaccgctataggtaacgtcgaggatctcttccgcttcttcctgttccgggttgttggcggtgattttcagctggttttcgctgacataaagacgtacgccgcggaatttctcgttagagagaatcgccgcgcgagcaaacgcctgcttgagcagatcgcagccagcttccagatgtttgtccgggttcttcggcagaacgcggcgataatccgggaagcgaccatccaccagtttggaggtgaagataaagtcgccaacgtgggcgcgaatgttgttgctgccaatctgtacgcgcagcggattgtcgccgccgtcgagcatacgcatcagttcaatcacgcctttacgcggtacgatcaccgaatggcttggcaaagattgaccaattggcattgaacagaccgccagacggtggccgtcggttgccacggtgcgcagttcttcaccttcggtttcaaacagcataccatttaagtaatagcgaacgtcctgatgcgccatagaaaactgggtcgcttcaatcagacgcttcatcgttgcctgcggcagggtaaattcgacttcactctgccagtcatcgaggttcgggaaatccgccgctggcagggtagacagcgaaaaacggctacgcccggagcgtaccagcatccgttcaccttccagctgcacggcaatttccgcgccttcaggcagaccacggcagatatcaaagaatttgcgcgccggaacggtcgtcgctcctggctcgtgtggctgaaccagcgcaacacgtgccaccatttccatctcgagatcagtaccggtcagcgacaacgtaccgtcagcaacctgtaacagcagattaccgagaatcggtagcgtaggacgaccacctaacggaccgctcacctgttgtagcggttttaataaatgctcacgttctacggtaaatttcataggtttacgatgacaatgttctgattaaatttgaaaaatcttctttgatatcgtggctctcttcacgcaactgctcgatcttacggcaggcatgaagcaccgtcgtgtggtcacgaccaccaaacgcatcgccaatctccggcagactgtggttagtcagctctttcgccagcgccatcgccatctggcgcggacgcgccaccgagcgggatcgacgcttggaaaggagatccgcgactttgatcttgtagtactccgccaccgtcttctgaatattgtcgatggtgaccagtttttcctgcaatgccagcaagtcgcgcagcgcctcacgcacgaagtcgatggtgatcgcccgtccggtaaagttggcattggcaatgacgcggttcagcgccccttccagctcacgtacgttagatcgtagacgcttggcgataaagaacgccacttcgcccggcaaacgaatgtcgttttcgtcggcctttttcatcaggatcgccacacgggtttccagctctggcggttcgatcgccacagtcagtccccaaccgaagcgggatttcaaacgatcctcaacgccgttgatctctttcggatagcgatccgaggtgagaatgatctgttgattaccttccagcagggcgttgaaggtgtggaaaaactcttcctgagatcgttctttattagcaaaaaactgaatatcgtcgatcagcagtgcatctacggaacggtagtagcgtttaaactcttcgatcgcgttgttttgcagggctttaaccatgtcctgaacaaagcgctcggagtgcatataaaccactttggcattcggcttgcgcgccataatgccgttacccaccgcatgcagcaggtgagttttacccagacccgtgccgccataaaggaacaacgggttataggcaccgccagggttatccgccacctggcgagccgccgcgcgcgccagttggttagatttaccttcaacgaagttatcaaacgtgtgtttgacgtttacgttagaacgataggtcggttctgccggggccgggacgttatcccaacctgagcgcgtagaaggcgcagcacgttgcggctgcgtttgcgccacctgtgcaggggccgcgacgttgctcgtcactgccgcttgtggcgtttgcgtcaccggtttggtgccgacttcaaaacgcagctgtggggcatccgctccgcagaaactggttagcagtccattgatattattaaggtacttgtcccgtacccaatcgaggacaaaacggtttggcgcgtacagggccagcgtgttatcgctcagttccgcctgcaatgggcgtatccacatactgaattctgtggctggtaactcatcctgcaatcgggcaagacactgctgccaaagcgaaagtgacacggcggactccactcgaacaaaagtcgataatgactaaggctgaaacattcatgattgttgacgtacgtcgaaaagaccctgcttgagggtgacgcacgaaccgctgtctgcggttatatgcccgatcaagatcctgcaaaacgatcgggaccgcggatcatagcctaaactgcgcaagagatcttctgtttctcacagattttcccgatttatccacaggactttccagaactcgctaagtgtaaacgatcctgccgcgaggcgggcacgatttacgccgcatattggaaaatttaatgaccatagacaaaaattggcttaatcgatctaataaagatccaggacgatccttgcgctttacccatcagcccgtataatcctccacccggcgcgccatgctggtttccactggtgtgaggtcgtacattttccctgcgaaaaggtgcggaaaagcgcggtaaataaggaaagagaattgactccggagtgtacaattattacaatccggcctctttaatcacccatggcttcggtgtccatcgtttcatttttcggcggatatccaataaagccattgaatttattcaagtttaggtagaaatcgccatgaaacgcacttttcaaccgtctgtactgaagcgcaaccgttctcacggcttccgtgctcgtatggctactaaaaatggtcgtcaggttctggcacgtcgtcgtgctaaaggccgcgctcgtctgaccgtttctaagtaataaagctaacccctgagtggttaagctcgcatttcccagggagttacgcttgttaactcccagtcaattcacattcgtcttccagcagccacaacgggctggcacgccgcaaattaccattctcggccgcctgaattcgctggggcatccccgtatcggtcttacagtcgccaagaaaaacgttcgacgcgcccatgaacgcaatcggattaaacgtctgacgcgtgaaagcttccgtctgcgccaacatgaactcccggctatggatttcgtggtggtggcgaaaaaaggggttgccgacctcgataaccgtgctctctcggaagcgttggaaaaattatggcgccgccactgtcgcctggctcgcgggtcctgatagccctcattcgggtctatcaacgcctgattagtccgctactcgggccgcattgtcgtttcactccaacctgttcaagctacggaattgaggcattgcgcaggtttggagtgataaaaggcagttggttgacggtgaaacgcgtattaaaatgccaccctttacaccctggtggtgacgatcccgtcccgcccggaccatttgataccagagaacactaacgatggattcgcaacgcaatcttttagtcatcgctttgctgttcgtgtctttcatgatctggcaagcctgggagcaggataaaaacccgcaacctcaggcccaacagaccacgcagacaacgaccaccgcagcgggtagcgccgccgaccagggcgtaccggccagtggccaggggaaactgatctcggttaagaccgacgtgcttgatctgaccatcaacacccgtggtggtgatgttgagcaagctctgctgcctgcttacccgaaagagctgaactctacccagccgttccagctgctggaaacttcaccgcagtttatttatcaggcacagagcggtctgaccggtcgtgatggcccggataacccggctaacggcccgcgtccgctgtataacgttgaaaaagacgcttatgtgctggctgaaggtcaaaacgaactgcaggtgccgatgacgtataccgacgcggcaggcaacacgtttaccaaaacgtttgtcctgaaacgtggtgattacgctgtcaacgtcaactacaacgtgcagaacgctggcgagaaaccgctggaaatctccacctttggtcagttgaagcaatccatcactctgccaccgcatctcgataccggaagcagcaacttcgcactgcacaccttccgcggcgcggcgtactccacgcctgacgagaagtacgagaaatacaagttcgataccattgccgataacgaaaacctgaacatctcttcgaaaggtggttgggtggcaatgctgcaacagtatttcgcgacggcgtggatcccgcataacgacggtaccaacaacttctataccgctaatctgggtaacggcatcgccgctatcggctataaatctcagccggtactggttcagcctggtcagactggcgcgatgaacagcaccctgtgggttggcccggaaatccaggacaaaatggcagctgttgctccgcacctggatctgaccgttgattacggttggttgtggttcatctctcagccgctgttcaaactgctgaaatggatccatagctttgtgggtaactggggcttctccattatcatcatcacctttatcgttcgtggcatcatgtacccgctgaccaaagcgcagtacacctccatggcgaagatgcgtatgctgcagccgaagattcaggcaatgcgtgagcgtctgggcgatgacaaacagcgtatcagccaggaaatgatggcgctgtacaaagctgagaaggttaacccgctgggcggctgcttcccgctgctgatccagatgccaatcttcctggcgttgtactacatgctgatgggttccgttgaactgcgtcaggcaccgtttgcactgtggatccacgacctgtcggcacaggacccgtactacatcctgccgatcctgatgggcgtaacgatgttcttcattcagaagatgtcgccgaccactgtgaccgacccgatgcagcagaagatcatgacctttatgccggtcatcttcaccgtgttcttcctgtggttcccgtcaggtctggtgctgtactatatcgtcagcaacctggtaaccattattcagcagcagctgatttaccgtggtctggaaaaacgtggcctgcatagccgcgagaagaaaaaatcctgattcggtgagttttcgctaaaataagggcggtcagttgaccgccttttttcttttcgtagggcggataagcaccgcgcatccgccacacaaagcaacaggaacatcatgagcgataatgacactatcgtagcccaggccacgcctccgggacgtggcggcgttggcatcctgcgcatctccggcttcaaagcccgtgaagttgccgaaaccgtgctgggtaaactgcctaagccgcgctacgccgattatcttccgtttaaagacgccgacggcagcgtgctcgatcaggggattgcgctatggttccctggcccgaactcgttcaccggcgaagatgtgctggaactgcaaggtcatggcggtccggtgatcctcgacctgctgttaaaacgcattctgaccattcccggcctgcggattgctcgccctggtgagttttccgaacgcgcgtttcttaacgataaacttgacttagcccaggccgaggcgattgccgatcttatcgacgccagttcggaacaggcggcccgttcggcacttaactcgctgcaaggcgcattctccgcacgggttaatcatctggtagaagccctcacccacttgcgcatttacgtcgaagcggcaattgatttccccgatgaagagatcgatttcctctccgacggaaaaattgaagcccagcttaatgacgtgattgccgatctcgatgcagtgcgtgctgaagcacgtcagggtagtttgttgcgcgaagggatgaaggtggtgattgccggacgtcctaacgccggtaaatcgagcctgttaaacgcgctggcgggccgtgaagcagcaatcgtaactgatatcgccggaaccacacgtgacgtgctgcgtgagcatatccacattgacggaatgccgctgcatatcatcgataccgctgggctacgtgaagccagtgacgaagtggaacgtattggtatcgagcgcgcgtggcaggaaattgaacaggccgaccgcgtgctgtttatggtcgatggcaccacaacagacgccgtggatccggcagagatctggccggaatttatcgcccgtctgccagcgaaactgccgatcaccgtggtgcgcaataaagccgatatcaccggcgaaacgctgggaatgagtgaagtgaacggtcacgcgttaattcgtctctcggcaaggacaggtgaaggcgtggaggtgctgcgtaaccatctcaaacagagcatgggctttgacaccaacatggaaggcggcttcctggcgcgtcgtcgccacctacaggcgctggaacaggcagcggaacatctacaacagggcaaagcgcaactgttgggagcctgggcaggtgaactgctggcggaagagttgcgtctggcacagcagaacttaagcgaaatcaccggggaatttacttcagacgacctgctggggcggattttctccagcttctgtattggtaagtaaccgcgcttacgaagccgcattctgactgtcagatgcggcttcgcttcattgttaccactcctgttattcctcaaccctttttttaaacattaaaattcttacgtaatttataatctttaaaaaaagcatttaatattgctccccgaacgattgtgattcgattcacatttaaacaatttcagaatagacaaaaactctgagtgtaataatgtagcctcgtgtctttcgaggataagtgcattatgaacatcttacatatatgtgtgacctcaaaatggttcaatattgacaacaagattgtcgatcaccgcccttgatttgcccttctgtagccatcaccagagccaaaccgattagattcaatgtgatctatttgtttgctatatcttaattttgccttttgcaaaggccatctctcgtttatttacttgttttagtaaatgatggtgcttgcatatatatctggcgaattaatcggtatagcagatgtaatattcacagggatcactgtaattaaaataaatgaaggattatgtaatggaaaactttaaacatctccctgaaccgttccgcattcgtgttattgagccagtaaaacgtaccactcgcgcttatcgtgaagaggcaattattaaatccggtatgaacccgttcctgctggatagcgaagatgtgtttatcgatttactgaccgacagcggcaccggggcggtgacgcagagtatgcaggccgcgatgatgcgcggcgacgaagcttacagcggcagccgcagctactatgcgttagccgagtcagtaaaaaatatctttggttatcaatacactattccaactcaccagggccgtggtgcagaacaaatctatattccggtactgattaaaaaacgcgagcaggaaaaaggcctggatcgcagcaaaatggtggcgttctctaactatttctttgataccacgcagggccatagccagattaacggctgtaccgtgcgtaacgtctatatcaaagaagccttcgatactggcgtgcgttacgactttaaaggtaactttgacctcgaaggattagaacgcggtattgaagaagttggcccgaataacgtgccgtatatcgttgcaaccatcaccagtaactctgcaggtggtcagccggtttcactggcaaacttaaaagcgatgtacagcatcgcgaagaaatacgatattccggtggtaatggactccgcacgctttgctgaaaacgcctatttcatcaagcagcgtgaagcagaatacaaagactggaccatcgagcagatcacccgcgaaacctacaaatatgccgatatgctggcgatgtccgccaagaaagatgcgatggtgccgatgggcggcttgctgtgcatgaaagacgacagcttctttgatgtgtacaccgagtgcagaaccctttgcgtggtgcaggaaggcttcccgacatatggcggcctggaaggcggcgcgatggagcgtctggcggtaggtctgtatgacggcatgaatctcgactggctggcttatcgtatcgcgcaggtacagtatctggtcgatggtctggaagagattgacgttgtctgccagcaggcgggcggtcacgcggcattcgttgatgccggtaaactgctgccgcatatcccggcagaccagttcccggcacaggcgctggcgtgcgagctgtataaagtcgccggtatccgtgcggtagaaattggctctttcctgttaggccgcgatccgaaaaccggtaaacaactgccatgcccggctgaactgctgcgtttaaccattccgcgcgcaacatatactcaaacacatatggacttcattattgaagcctttaaacatgtgaaagagaacgcggcgaatattaaaggattaacctttacctacgaaccaaaagtattgcgtcacttcaccgcaaaactgaaagaagtttaattaatactacagagtggctataaggatgttagccactctcttaccctacatcctcaataacaaaaatagccttcctctaaaggtggcatcatgactgatcaagctgaaaaaaagcactctgcattttggggtgttatggttatagcaggtacagtaattggtggaggtatgtttgctttacctgttgatcttgccggtgcctggtttttctggggtgcctttatccttatcattgcctggttttcaatgcttcattccgggttattgttattagaagcaaatttaaattatcctgtcggctccagttttaacaccatcaccaaagatttaatcggtaacacctggaacattatcagcggtattaccgttgccttcgttctctatatcctcacttatgcctatatctctgctaatggtgcgatcattagtgaaacgatatcaatgaatttgggctatcacgctaatccacgtattgtcgggatctgcacagccattttcgttgccagcgtattgtggataagttcgttagccgccagtcgcattacctcattgttcctcgggctgaagattatctcctttgtgatcgtgtttggttctttcttcttccaggtcgattactccatcctgcgcgatgccaccagcaccactgcgggaacgtcttacttcccgtatatctttatggctttgccggtgtgtctggcgtcatttggtttccacggcaatattcccagcctgattatttgctatggaaaacgcaaagataagttaatcaaaagcgtggtatttggttcgctgctggcgctggtgatttatctcttctggctctattgcacgatggggaatattccgcgcgaaagctttaaggcgataatctcctcaggcggcaacgttgattcgctggtgaaatcgttcctcggcaccaaacagcacggcattatcgagttttgcctgctggtgttctctaacttagctgttgccagttcgttctttggtgtcacgctggggttgttcgattatctggcggacctgtttaagattgataactcccacggcgggcgtttcaaaaccgtgctgttaaccttcctgccacctgcgttgttgtatctgatcttcccgaacggctttatttacgggatcggcggtgccgggctgtgcgccaccatctgggcggtcattattcccgcagtgcttgcaatcaaagctcgcaagaagtttcccaatcagatgttcacggtctggggcggcaatcttattccggcgattgtcattctctttggtataaccgtaattttatgctggttcggtaacgtctttaacgtgttacctaaatttggctgatcccttcaagaagccagccatttcgctggcttcttgcctgtcaggaaatctcttttgtccaaatggcaactcgcctgattctccttcaccacgtatgctttgcgtcaccttactatcaggacgctttagcccatgtcccgctttttaatttgtagttttgccctggttttactttatcccgccgggattgatatgtacctcgttggtttaccgcgcatcgccgccgatctcaatgccagcgaagcgcagttgcatattgcgttctccgtatatctggcggggatggcagctgcgatgttatttgccggtaaagtggccgatcgttcagggagaaagccggtcgccatacccggcgcggcgctatttattattgcctcggtgttctgttcactggctgaaaccagcacgttatttcttgcaggccgatttctacaggggttgggcgcaggctgttgttacgtagtggcgttcgccattttgcgcgacacgctggatgatcgacgtcgggctaaagtgctgtcattactcaacggtattacctgcatcattccggtgttagcgccagtgctcggacatctgattatgcttaaattcccgtggcagagtctgttctgggcgatggcaatgatgggcatcgcggtactgatgttgtctttgtttattttaaaagaaacgcgcccagcgtcccccgctgcttcggacaaaccacgagaaaatagcgagtcgctgcttaatcggtttttcctcagccgtgttgttatcaccaccctcagcgtttcggtgatcctcactttcgtcaatacatcgccggtattgctgatggaaatcatgggttttgagcgcggagaatacgccaccattatggcgttgaccgctggcgtcagcatgaccgtttcattctccacgccatttgcgctgggaatttttaagccacgtacgttgatgatcacctcgcaggtgttattccttgcagcggggatcacccttgccgtttcaccttcccatgcggtttctctgtttggtatcacgctgatttgcgccggtttctcggtaggttttggcgtagcgatgagtcaggcgttaggaccattttcattacgcgcgggcgtagccagctcgaccttaggtattgcgcaggtttgcggttcgtcactgtggatttggctggcagcggtggttggtatcggcgcatggaatatgctgatcgggattctgattgcctgtagcatagtgagcctgttgctgattatgttcgtcgcgcctggacgccccgttgccgctcatgaagaaatccatcaccacgcttgatctcaatctgctgctctgtctgcaactgctgatgcaggagcgcagcgtgaccaaagcggcgaagcggatgaacgtgaccccttcagcggtgagtaagtcgctggcaaagttaagagcgtggtttgacgacccgctctttgtgaactcaccgctgggcctgtcgcccacaccgctaatggtcagcatggagcaaaatctggcggaatggatgcaaatgagcaatctgctgctggataaaccgcaccaccagacaccgcgcggcctgaagtttgagttggcggcggaatcgccgctgatgatgatcatgcttaatgcgctgtcgaaacggatctaccaacgttacccgcaggcgaccatcaaactacgtaactgggattacgattccttagatgccattactcgtggtgaagtggatattggtttttccggtcgcgaaagccatcctcgctcgcgggagctgttaagctcgctaccgttagccattgattatgaagtgctgtttagtgatgtaccctgcgtctggttacgcaaagatcatccggcactgcatgaaacgtggaatctggacacctttttacgttatccgcatatcagcatttgctgggaacagagcgacacctgggcgctggacaatgtgttacaggagctggggcgcgaacgcacgattgctatgagcctgccggaatttgagcagtcactgtttatggcagcgcaacccgacaatctgctactggcgaccgcgccgcgctactgtcagtactacaatcaactccatcaactgccgttggttgctcttcctctcccgtttgacgaaagccagcaaaaaaagctggaagttccttttaccctgctgtggcataaacggaacagccataatccgaagatcgtctggttacgggaaaccattaaaaacctttacgcgtcgatggcataaccgaatcgtatgaaacgcgacccaatttcacaataaaatgtaaaaaagttgtaataagcttgtctgaatcgaacttttagccgctttagtctgtccatcattccagtaaatgattactcttatattcataatggaccattaagcatggagcgaaaaatggcgactcactttgcccgagggattttaacggaaggacatctgatttctgttcgtctcccctcccagtgtcatcaagaagcccgaaacattccccctcatcgtcaaagccgttttctggcgtccagaggtttactcgcagaactgatgttcatgctgtatggcattggcgaattgccggaaatcgtcaccctgccgaaaggtaaaccggttttcagtgataaaaatttgccttcgttttctatttcctatgccgggaatatggttggcgtggcgttaacaaccgaaggtgaatgtggcctcgatatggaactacagcgtgcgacgcgcgggtttcatagcccacacgcgcccgataaccacaccttttccagcaatgaatcgctatggatcagtaaacaaaacgatcctaacgaagcgcgggcgcagctcatcacgctgcgccgaagcgtgctaaaactaaccggtgatgttttgaatgacgatccgcgcgatctgcagctgctgcccattgccggacgcctgaaatgtgctcatgtaaatcatgtagaagcgttatgcgacgcggaggacgtgctagtgtggtccgtggcggtcacgcccgcgattgaaaagctcagtgtctgggagttagatggcaaacacagctggaaaagcctgccggatattcacagccgcgccaacaatcctaccagccggatgatgcgttttgcccagctctctaccgtgaagtctttttcgccaaattgatagacaaccacaggagtcattatgtctgaaaaattgcaggtggttacgttactggggagcctgcgcaaaggctcatttaatggcatggttgcacgtaccctgccgaaaattgctccggcgagcatggaagtcaatgcgttaccttccattgccgacattcccctgtatgacgctgacgtacagcaggaagaaggttttccagcaacggttgaagctctggcggaacagatccgtcaggctgacggtgtggtgatcgtcacgccggaatataactactcggtaccgggtgggctgaaaaatgccatcgactggctttcccgcctgccggatcaaccgctggcgggtaaaccggtgttgattcagaccagctcaatgggcgtgattggcggcgcgcgctgtcagtatcacctgcgccagattctggttttcctcgatgcaatggtgatgaacaagccggaatttatgggcggcgtgattcagaacaaagttgatccgcaaaccggagaagtgattgatcagggtacgctggaccacctgaccgggcaattgaccgcatttggtgagtttattcagcgagttaagatctaaataaaaaacccgccagtaatcatgcatggcgggtttttaatgcgctatcgattttaatgagcgtcgataaatacaatcttcaggataaacagcagcgcaacgatgattacgcacgggctaaggtcacgcagacgcccggtaccaatcttcatcacgcagtaggagataaagcccagcgcaataccttcggtaatcgaaaagctgaacggcatcatcacggcggtaataaacgccggaacagattcagtaagatcctgccagttcacgcgagcaagacttgaggtcatcaacacgccaacgtagatcaacgcgccagctgcagcgtagcctggcaccattcccgccagcggcgacagaaagataaccagcaggaacagcagaccaacaaccactgccgtcagaccggtacgaccgccaaccgatacgccggaagaggactcaatataagccgtaacggaagaagtaccgataaacgaaccggtcacggaagagatactgtcgacatacagcgcctgcttcatgcgcgggaatttccccttctcatccgccagacctgctttatcggtcacgccaatcagcgtaccggaggagtcaaacaagttgaccaacatgaaagagaaaatcacccctgccagcccgaggttaaacgacccggctaaatctacatgacccacaactgtcattacgctcggcggcgcagaaacgatgccattgtagtgcacatcacccagcatccagcccagcagcgtcgtcaccacgatagaaaccagcaccgctgcgtgaatgttgcgcgaggccagaatagcaatgatgaagaagccgaggatacccagaagtacgctgtgagaagtcagattaccgatgctcaccagcgtttccgggttagcgacaatcacacctgcgtttttcagccccatcatgccaatgaacagaccgataccgctggtaatacccacacgcagactcaccggaatgttggctatcatccagtagcgaacgcggaaaatcgtcagtaacagcagacctatcgcgccccagaagattgcgcccatcccgacctgccacggcaagcccatcgcctgtacaacgacaaaagcgaagaacgcattcaggcccatagcgggtgccagtgcaactggcaggttagcaaacagtcccatcataatactgccgaatgcagcgatcagacaggtagtgacgaagacggcgctggtatccatgccagcaacgccaagaatttgcgggttaacaaaaacgatgtaaaccatcgtcaggaaggtggtaaaaccggcgatcacttcggtccgtgccgtcgtgccatgttcgcgcagtttaaacacgcgttccagcatcccctggccagaagcctgggttgtgtgttgttgactcattatctatttccgaacaaggagggaaaatccgtcgctatcgtataccaaaatgagacaatatggacggctgaagataactttttttcattgtatttgcttatacggcaacgattgcgtcatgcgaattggcatgacgaaaacgttaaactaacgataaaggaaagacatgtcccagatagaagcggtatttttcgactgcgacggtacgctggtcgatagcgaggtcatttgctctcgcgcatatgtaacgatgtttcaggaatttggtattacgctcgatcctgaagaggtattcaaacgtttcaagggtgtaaaactgtacgaaattatcgatattgtttcccttgaacatggtgttacgttagcgaaaacagaagctgaacacgtttaccgtgcagaagtcgctcggctgttcgattcagaactggaagccatcgaaggggctggagcgctcctgtcagcgatcactgcgccaatgtgtgtggtatctaacggcccaaataacaaaatgcagcattctatgggcaagctgaatatgttgcactacttcccggataaactgttcagcggctacgatattcagcgctggaagccagacccggcgttaatgttccatgcggcaaaagcgatgaatgtaaatgtagaaaactgcattctggttgatgactcagttgccggtgcgcaatctggtatcgacgcaggtatggaagtgttctacttctgcgccgacccgcacaataagccgatcgttcacccgaaagtcaccacctttacccatctttcgcagttaccggaactgtggaaagcgcgtggttgggatattacggcatagttcttcacactcccttcacttaccccgcttaaattggcgctcaaaggtaagttaagggtgtttgatatgtctgtttcacgtcgggtaatacatcacggactttattttgcggttttaggaccgttaattggtgttctgtttcttgtcctctacatattcttcgcaaaagaaccgctggttcttttggtaataatacaggtacttccattgtttctcttattgtcgattactacgggagctattcctgcattgttaaccggcgtgatggtcgcctgtctgccggaaaagatcgggtcacagaaaaattatcgttgtctggctggtggcataggtggcgtcgttatcaccgagatctattgtgcagttattgtacatattaagggcatggcttcctcggagttgtttgaaaacattctttctggtgacagtctcgttgtccgcatcattcctgcattgctggcaggtgtggtgatgagcagaatcattacccgtctgcccggattggatatttcatgtcctgaaacagactctttaagttaagcgggatactttatctttgggctactcaaaagcagacaggatgttactatgactcaaaatatcaggccgttaccccaattcaaatatcatcccaagccactggaaacaggcgcatttgaacaggataaaaccgtagagtgcgattgctgtgaacaacagacgtcagtttattactcgggtcccttttattgcgttgatgaagttgaacatctctgtccgtggtgtattgcggacggttctgctgctgaaaagtttgcaggtagttttcaggatgatgccagcatagaaggtgttgaatttgagtatgatgaagaggacgaatttgccggtattaagaacacatatcctgatgaaatgctgaaagagttggttgaacgcacgccaggttatcatggatggcaacaggaattctggcttgcgcattgtggcgatttctgtgcttttatcggctatgtgggctggaatgatataaaagatcgcctcgatgaatttgccaaccttgaagaagattgtgagaatttcggtattagaaattctgatctagctaaatgcctgcaaaagggtggtgattgtcagggttatctcttccgctgtctccactgcggcaagctgagactgtggggtgatttttcgtagttatttaaataatgagaacaggccggagcgtaattcatacatccggccttatttcttcagcttaaccgagcgctaattctgcggcagcggctttatcagcgattaccatcagcgaaggatgcagctgcaacacggaagctggaacatcttcggtaaccggaccttgcagaacatttttcagtgcctgcgctttacctgcgccactgacaattatcagcaagtttttcgccgccatgatgcttttcggccccatcgtcacgtagctgtcaggcactaacgaaaagtcgccgcccaactcaccatgcgccacaatatcaaccatctctccctggatcgggaactccacggtttgctcatggaaatgggtcgtattcggcaaattgccacaaaaatgaccatctgcacctaatcccagcaccaccaaatccaggccgccttcacgcgccagtttctgatcatgctcgcggtagttatcaatagtgagcttctggatattctcttctttgatccccgcaggggtgaaaaacagattacgcagattggtaatcgttacaccttctccctctttgccgcgaaagggaatttcatcgaaattatagaaatagcagttatcgtaccagggcttacctttaaccagggtggtgaggtattcatacatgcctttgggcgtgctaccggcggtaattgccaggttaacacgacgcgtcttcgacatataaccaagcagatggtgtgccgcgacacggctcatttcctggtaatcttcggtaatgattaatttcatcttagtgccttattttatttaaataatttctgtacgaaggctgcataggcaggccgccagacatccatttcatggttcaggccgggatattcctggtaatcaaacttaatttttttctgctcaagctcagttttcagcccggcgatatccttgccggttacgacatctttatcaccaacgaccacagtaaaattacgtagttgctggttaatagctgccggatcgttcagccgggccgcgacaccttcatccggtacggttgtcgtggtaacaccactgaatgtggccagccagccaaagctttccagatgattcattcccgataccagcgcctgatacccaccttgtgaaagccctgccagtgcgcgaccatcggcatctttacggacgttaaaacgcctgctaatcagcgggataatatcgttcatcagttcgcgatctgccgctttagcattcagcggataaaagactttacgtctttcctgaggcacgaaatcttcgggaataatgcccttcgcatcggtttcggtatctgggatcaccaccagcatcggtttaattttcccttcagccagcaggttatccatgatttgcgggatacgcccctgatcgatagcggaacgtccagtatcaccaaagccgtgatagaaatagagcactggcaaaggctcgcccatgccggtgtatcctggcggggtccagacatacatctgacgttcagattgcaatgcgttggagtggtaagttatggcgatcaaatcaccatgcgcaacagaacgcgtatccagataactacctggcaccagaatcatactggagttaacctggcgctgaggcttagtcattgcggtgccagtatcaatgctgcgtacaccatcaacattgaaaaaatattcgtacagattgcctttcaggacaggtgtgcgccacgaccagactcccgcttcgtctttggtcatcgggtgaatattgtccggaaccggaacacccaccactacggagacgttttttgccccaggggcaaagtagcgaaaggtcacgctgttatcggcattgacctgagtcacatactgtttaaccggaatagtgggtgccgggctggctggcatatccgctgctatggcccactgagcagaaataccgctggcaatagccagcgttaaagcagcaatttttatattcatcgtaatattcctttcattaagttccattaccaccagatttcagcctgggcaccgacagcaaactggtcgtctttattgtcttcaaaggtgaagccatccagttcgttttccagggctttgatatacgtggcgtagaaacgaatttccggacgcgaggtcaacatactggtattgactttaaaggtatggaagagcgtggttttataaccagactcattaaatttattactattcgcatctttgttttgctgggtgaaatagcccagttcaacacctgtctggttatattggtcccaaatataggccgggcgaacaaccgcacgaatagattcgaaatcagagtgggcgcctgtttcgtagctatatatatcgttaccgaaggagtaaacaatcgcgttagctacaatgaaatgatcgccaatataggcttcgccctgcgaagtcagacgtaccgctgttccgccggtgtgatcaccataataacgaccattaaaggtggtaaatggacttgcgccagcataacggccaaagttactggcgatagaattattcgcgaccaggaaggagaattcgttgaagccacctttatcaaatttctgcgttaaagatgtgccaaacatccaggtatctttccagtcataatacccgttattatcctgattatctttttccgatgcgctttcgtttgccgtgacataacgaccacttaccattaaggtggctttatcccataacgggatatctttatagcgtaaatcaatggtattggtattaatctgctgtttgttttgcaggctgcgatcgtaatcatcgacatcttcgcgaaccagcgcgatatcaattttacccggaccgactttccagttttccagacctacacccgctgcggcatcagtacgctgcgttttccagtcaagcatctggatttcaattttcggcgcaccgtgtttacccacccagaaatcagcctctggcgcaaagggcaggaaacctttggtggtaacgtacatatcggagaactgcatatagttctcgccaccggcgttatcgccaaaccagccggtagagtactgctgaccaacgttaccatccatcatcacaacggcatcaacccgtttgccgttttcgttgtagacacgttgttttaactgcaaatcaaaccagccggagtattcgttaccaaagcggcccagagaaccaatcgcccatgatttaggtgaaccatgagaggcggtcccccaaccagaacggtaatagccgttgtaactaaagccaatttcatctttcacaaatttactgaaatctttcagagtcatggaagaataaatcgagcctgtctcactggcatttttctcttcatttttgaccagtacagcatcaggttttgcggcactactggtcgggaacggattggcggcatacccttgatcattcgtacttacgctacgattcaccgtcgctggcgtatactttttcttctcttcatctttatactttttgagttcgctttgcgtttctcttaacgccttttctaataactcaaggcgttgttccaccgttaatgattcagccaatgattgtgcagaaaaggctaacggtgccattaataagatggcagaggtaataagatttcgtctaaacataatatccctttatggtgcaaagaaagaattaacgcatcgcatccagactgttctgaatgcgacgataattaaggtgctttaatggttattttttttaatgacagcccccgcgtcttgatcacctctgcataccatccgaagcttttcttgcgtgttcttgtgaggcttccttcgccattatcatcacgatccacataaataaagccgtagcgcttagacatttgtgaatgagatgcactgactaaatcaattggcccccaactggtgtaccccataatatacacaccatcggcaatcgcttcatttacctgtaccaggtgatcgtttaaataggcaattcgataatcgtcctgtatcgaaccatccgcttcaacgctgtcttttgcgcctaatccgttctcgacaataaataacggtttttgataacgatcccaaagcgtatttaacagaacccgtaatccaaccggatcaatttgccacccccactctgaacttttcagatgcggattggggatcatattcagtatgttgccctgcgcatttttattaatgctttcgtcgtgggaaacacaaccagtcatgtaataactaaaagagatgaaatcgacggtatgttttaaatcttctgcgtcactttcagtcatctcaatggtgatattgtggtcgcggaagaaacgctgcatatagccgggatactggccacgcgcctgaacatcaccaaagaacatccagcgccggttctcttccatggcctgcaacatatcctgtggctggcaggtgagggggtaaaccagcccaccgagaagcatattgccgattttcgcttcgggtagcaggctatgacaggctttaactgcccgcgcactggcaaccagttgatggtggatagcctgataaacttccgcctcgccactctcttctgccagccccacgcccgtgaatggcgcgtgtaacgacatgttgatttcattaaacgtcagccataacgccactttatgttggtagcgagtaaagaccgtgcgggcgtaatgctcgaagtgatcgatgaccgctcgattagcccaaccgccgtagtttttcaccagcccatatggcatttcgtaatgggataacgttaccagcggcttgatccccgcctgcgccatttcatcaaacagccgatcgtaaaacgctaaccccgcttcattcggttcgacttcgtcgccctgagggaaaattcgcgcccaggcaatggaaatacgcagacaggtgaagcccatctcggcaaataacgcgatatcttccgagtaacggtgataaaaatcgatggcgacatctttgatattctctttccccaggatgcgcggttccatttttcccattacgccatgaggctgtaaatctgaggtcgagatccctttgccatcttcctgccaggcaccttccacctgattggcagctgttgcgccaccccaaagaaatgtttctggaaatgctttcataattaactccttttatcgttagcgaatgatggataacagcggttcacctgcgcttatctgcgccgtgccgtggggtaatacgtccgtaaaatcatcgctattactgattaataccggcgtcgtcagatcaaatccggcctcgcgaatagcagggatatcaaaagaaatcagccgatcgcctgtattgaccttgtcacccacgttgacgtgagcggaaaagaatttgccgtccagttttacggtgtcgataccgacatgaatcaggatctccacaccatcatctgactcaatgccaatggcgtgtaatgtggcgaacaacgaagcaattcgacccgcaaccggagaacgcacttcaccaaccgagggcagaatggcaatacctttacccaacaggccactggcaaacgtggtatcagcgacgtgaatgagcggcacaatctctcccgtcatcggtgaacagataccgccctgctcaggtggtgtaataacctctggtgttttctcttgcggggcaccctgcgctggctgacgtttagcggtgatgaaatgaagcatcaccgtaccgacaaatgcgcaaccgatggcaatgacaccgccaataacgctggcccagacggtgaaatcaattcccgttgacgggatggtttgcatgaaggtgaaaatacttggcaaaccaaaggagtagactttcgtttgcgcgtagccaatgatggtggcccccaaagccccactgatacaggcgataacaaaggggtacttacgcggcaggttgacgccatataccgctggttcggtgataccaaacagactcgtcaacgccgctgatcccgccaccacttttttctgcgcatcgcgttcgcagaggaagacgccgagcgccgccccgacctgcgccataatggcgggcattaacagcgggatcatggtgtcgtagcccagcacggtgaagttattgatacacagcggcaccaggccccagtgcagtccgaacatgacgaagatttgccagaagccgcccattaccgcgcccgcaaatgcaggaaccgcctgataaagccagagataaccggcggcaatcagttcgcttatccaggttgatagcggccccaccagcagaaaggtgacgggtctgataaccatcagacatagcaatggtgtgaagaaatttttgattgccgacggtaaccacgcattaagtcggcgttccagaatgctgcacaaccaggcagaaaaaataatgggaataaccgatgacgagtaattcaacaatgtgaccggaatacccaggaaatccagccccagcgcatccgctttttgcccgttctcgaaagcagtcagaattaatggatgcactaacgctccaccaatcaccatggcagtaaatggattaccgccgaagcgtttccccgcggtgtatcccaggattatcgggaagaaccaaaacaaggcatcactggcgctgaataaaattaaataagtaccactttgttcggtcgtccactgaaaagtgagcgccagagccagcatacctttcaagatcccggttgccgccatcaaaccgatcagaggcgtaaaaatacctgaaataacataaacaaagcggtttagcagattacctttatcatcattttccggtgcctgttgcgctttttcgtcaaggcctgccacactgttaaccgccaggaagacatcggccacatggttacctatgaccacctgaaactggccaccgctttccaccaccataataataccgggggtctttttcagtacctctgcttgcgctttgctttcatcctttaatttaaaacgtaatcgcgttgcgcaatgcatcagactcacaatgttatctgcgcccccgactcctgcgactatttttctggctaactccgtcataacttgccctctaccgctttgcggcaaaactccaaaaaaaaacctgaaaaaaacggcctgacgtgaatcaagcaatttttttcaggttttgcccgcttagtgcggtaacaatcctttactcagtaataatatttcagtgttctttgcgcacgcgctctatatttatggctaaaaacataatctctgcgggtgaaattttacgttgatactgcaaaccaataaaaatggcgatccgttccgcacattgccatgcttgcgggtaattttgttttactgcttgttgtaatgattcatcactatcgttaattgaagcatgttcaagaatacgccaggataaaaacttcagatgtgtaaccagtcgctgataactcaagctttcttcctggtaattaaggctgaactgaaattttattaattgcagcatttcgcgcattaactgcgtgacacctgcaacatcctccatatttccgctcatttgggcactgaccagatgcatggcaataaagcccacttcatctttcggtaactgcacgcccaaccgtttatcaataatggttaacgcttcttcccctagctggaactctttcgggtaaagccgctggatatcccacagcaacgggttgggcagcaacacgttttgctgaaagcgtttaatcgcaaactggcaatggtcagttagcgagatataaatactgtcctgtaattttcccaagcgctcctgcgctaaagagataatacgatcacaggttgccatcacctcaagaggaatatgacttaagagttcgcttaatcgcccgttcagttcatgactgctcaaggcatactctttttctattccacttgagttaattctttcgccagcgcgtttttgaaagccaattccgcgccccatgacgactttttcccgctgttgatcatcaataaccaccacaacattattgttgagaattttggtgatttgcatgttcatagcaaggaccttttttataaacaaaaaaacccgacttcaccagtattctctggttatgtcaggttttgcctgcgaatgcagtaacaatccagtcatttattaatggtttttataacgaacatccaggttcggaaattaatttaattgcgtgcagagaaaatagcaatgcgctattgataaaaatatgaccatgctcgcagttattaactttgtgtaattttaggaatttataaagttatatataacaaatcccaataattaagttattgggatttgtctggtgaattatttgtcgctatctttccccgccagcagtttatccagctcatcgccaccgacgtgacggaaatcctgccccttcacgtagtagaagataaactcacaaatattctggcagcggtcgccaatacgttcgatagaacgcgcgcagaacagcgcagtaagtacgctcggaatggtacgcgaatcttccatcatgtaggtcatcagttgacgaacaataccttcgtattcctgatcgacttttttatcttcacgataaatacgtaccgcttcgtcaatgtccatccgcgcgaacgcgtccagcacgtcgtgcagcatctggatggtatgacggcccagcgactccagacttaccagcaacggctgatgctgctgggagaatttctccagcgcagtacggcagattttgtccgccacgtcgccaatacgctccagctcggcaatggttttactgatcaccataaccagtcgcaggtcgctcgccgtcggctgacgtttggcgataatgcgcacgcaggcttcatcgatcgccacttccatcatgttgacgttcttgtcgccttcgatgacgcgcttcgccagatcgctgtcctggttatgcatcgcggtgattgcatcagaaagctgctgctccaccatgccgcccatggtcatcacctgcgtgcggatactttccagttcggcgttgaactggccggaaatatgtttattaagattgagactgtccataacgcactcctgaatcaaccgtaacgaccggtgatgtagtcttctgtttgtttcttcgctggcttggtgaacagatcgtccgtgttgctgaactcaatcaattcgcccaggtacataaacgccgtgtggtcggaacaacgcgcagcctgctgcatgttgtgggtgacgatcaccacggtgtaatcctgcttcagttcggtgatcagctcttcaatacgcccggtagagatagggtcgagcgccgaacacggttcgtcgagcagcagcacttccgggcgaatggcgataccacgcgcaatacacagacgctgttgctgaccaccagagagagagtaaccgctctggtgcaatttatctttggtttcgttccacaatgcggctttggtcaatgcccactgcacgcgctcgtccatatcggcacgggagagcttctcaaacagacgaacgccaaaagcgatgttgtcgtagatggacatcgggaacggcgtcggtttctggaacaccatgcccactttcgcacgcagcagggcgatatcctgagagttggtcaggatgttgtcgccatcaagcagaatttcaccttccgcacgctgctccgggtacagttcaaacattttgttgaaggtacgcagcagcgtcgatttaccgcagccggacggcccgataaacgccgtaacctggtttttggcgatatccaggttgatgtttttcagggcatggaatttgccgtagtagaagttcaaattacgaacctgaattttactcggggcagtttcaaccatactcattgcaatcttttcctcatcgtgcctgatgcacttcgctaatcaggcttaccgtaggccggatcaggcgttcacgccgcatccggcaaagtgttaaccgtgtacagagtcaaaaaggcactcggtcggtcccctcgcccctctggggagagggttagggtgaggggaaaaccgtgtcagcaatatcaaccgtgtttattcttcgcaaaaacaacgcgcgccagaatgttcagcagcagtacgcacagggtaatgatcaataccccggcccaggccaattgctgccattccgcaaacgggctcatcgcaaacttaaagatcgtcaccggcaggttggcgatcggctgcatcatgtccgtgctccagaactggttggagagcgcggtaaacagcagcggcgcggtttcaccagcaatacgggcaatcgccagcaggataccggtcataatcccggacaccgacgctttcagcgtaatcgcagagatcatcttccacttcggtgtacccagcgcataagccgcttcacgcaggctgtccggcaccagtttcagcatgttctcggtggtgcggataacaatcggcacctgcaacaacgccagggcaatcacgcccgcccagccggagaagtgctccatctgcgccaccacaatggtgtaaacaaacagaccaaccacaatcgacggcgcagagagcagaatgtcgttaatgaagcgaatcacttctgccagccaggatttacgaccatattccgccagataaatccccgccataatgcccagcggcgtaccgaataccgtggcccacaaaattaacaggccgctacccgccagggcgttcgccagaccaccaccttccgtattgggcggcggcgtcatttcagtgaacagcgccagcgacataccatcgataccgcgagtgatggtggacattaaaatccagatcagccagaacagaccgaaggccatcgtcgccatcgagagcgtcagcgcaatacggtttttgaggcggcgacgcgcctgcattttgcggcgagattcagccagcgccgcagtggtttgcatttcaaccatagccattagcgtgccccctcattcttagccaggcgcataatcataaacttcgatgcggcgaggacgatgaaggtaatcacaaacaggatcaggcccagttccatcagtgcggcaacgtgcagaccggattccgcttccgcaaattcgttcgccagcgcagaggtgatactgttgcccggcatatacagcgaggcgctgtcgagctggtaggtgttaccgatgataaaggtcaccgccatggtttcaccgagcgcgcggcccagccccagcatgatgccgccgataacaccatttttggtgaacggaagaacgatacgccagataacttcccaggtggtgcagccaataccgtaggccgactctttcatcatcaccggggtttgttcgaacacatcacgcattaccgccgcaatgtacggaataatcatgatggcgaggatcacgcctgccgcgaggataccgataccaaatgcggggccagagaacagcgcgccaacaatcgggatattcgacatgatattgccgaccggctcctgaaagtaaacggcgaacagcggcgcaaagataaacaggccccacatgccgtaaacgatacttggaatggctgccagcagctcaatggcgatacccagcgggcgtttcagccagccgggcgcaagctcagtcaggaacagggcgataccgaaactcaccgggacggcgatcagcagcgcgataaacgaagtcaccagcgtaccgtagatcggcaccaacgccccgtagatatcgttcggtgcatcccactctttggtccacaggaaagccagaccaaatttctgaatgctcggccaggaggagatgatcagagagacaataatgccacccaacatcaatagcacaatcagcgccgccagttttaccagcacgctgaaaattatgtcgccctttttacccggtgggttaaaagcaggcttggttgcagccataagttactcttcagttaaacgcgtttacaaagtcattttgtaatgccggataagccgttaatgccttatccggcctggagttttattagtacagcggcttaccgctactgtctttaatattggtcttccacgcagcgcgaacctgttcaacgacgctatccggcaggctggcataatccaggtcgttcgcctgtttagccccggttttgtacgcccagtcgaagaacttcagcacttctgtgccttgttctggtttcttctgatctttgtggatcagaatgaacgtggtagaggtaataggccatgcatcttcgcctttctggttggtcagatcctgagcgaaggttttgctccagtctgcaccttttgctgcattagcgaagttttcttcggtcggactaaccggtttaccatcagcggagatcagtttggtgtacgccaggttgttctgcttagcgtaagcatattcaacgtaaccaattgcacccggcagacgctgaacgaacgcggcgataccgtcattacctttaccgcccagaccgatcggccattttacggtagagccagtaccaacgttgtttttccactcttcgttcactttcgccaggtagctggtgaagacgaaggaagtcccggagccatctgcgcggcgtactacagcaatgttctgtgaaggcagtttcagacccggattcagtttggcgatggcttcatcatcccacttcttgattttgcccaggtagatgtcgccgagggttttaccatccagcaccagttcgccagacttcagccctggaatgttaacagccagcaccacgccgccaatcacggtcgggaactggaacaggccttcctgagccaatttttcatcagacagcggcgcgtcagaggcaccaaaatcaacggtattagcgataatctgttttacgccaccggaagaacctataccctggtagttaactttattaccggtttctttctggtaagtgtcagcccatttggcatacaccggcgcagggaaggttgcacctgcacctgtcaggcttgcttctgcaaacacagagaaagcgctcatcgataaggtcgcggcgacaacagttgcgacggtggtacgcataactttcataatgtctcctgggaggattcataaagcattgtttgttggctacgagaagcaaaataggacaaacaggtgacagttatatgtaaggaatatgacagttttatgacagagagataaagtcttcagtctgatttaaataagcgttgatattcagtcaattacaaacattaataacgaagagatgacagaaaaattttcattctgtgacagagaaaaagtagccgaagatgacggtttgtcacatggagttggcaggatgtttgattaaaaacataacaggaagaaaaatgccccgcttacgcagggcatccatttattactcaaccgtaaccgattttgccaggttacgcggctggtcaacgtcggtacctttgatcagcgcgacgtgataagccagtagctgcagcggaacggtgtagaagattggtgcaatcacctcttccacatgcggcatctcgatgatgtgcatgttatcgctacttacaaaacccgcatcctgatcggcgaagacatacaactgaccgccacgcgcgcgaacttcttcaatgttggattttagtttttccagcaattcgttgttcggtgcaacgacgataaccggcatatcggcatcaatcagcgccagcggaccgtgtttcagttcacctgcagcgtaggcttcagcgtgaatgtaagagatctctttcagcttcaatgcgccttccagcgcgattgggtactgatcgccacggcccaggaacagcgcgtgatgtttgtcagagaaatcttctgccagagcttcaatgcgtttgtcctgagacagcatctgctcaatacggctcggcaacgcctgcagaccatgcacaatgtcatgttcaatggaggcatccagacctttcaggcgagacagcttcgccaccagcatcaacagcacagttaactgagtggtgaatgctttagtggatgccacgccgatttctgtacccgcgttggtcattagcgccagatcggattcgcgcaccagagaagaacccggaacgttacagattgccagtgaaccaaggtaacccagctctttcgacagacgcaggccagccagtgtatccgcggtttcgccagactgtgacaaggtgatcatcaggctgttacgacgcacggcagatttgcgatagcggaattcagaggcgatttcgacgtcgcacggaatacctgctagcgattcaaaccagtagcgggaaaccataccggagttataagaagtaccacaggcgaggatctgaatatgctcaaccttcgacagcagttcgtcggcgttcggtcccagctcgcttaaatcaacctgaccgtggctgatgcgtccggtaagggtgtttttgatcgcgttcggctgttcgtagatctctttctgcatgtagtgacggtaaatgcctttatcgcccgcgtcatattgcagattggattcgatatcctgacgttttacttccgcgccagttttatcgaagatgtttaccgaacggcgagtgatttccgcaatatcgccctcttcaaggaagataaagcgacgggtcaccggcaacagcgccagctggtcagaagcgataaagttttcgcccatccccaggccaatcaccagcggactaccagaacgtgccgccagcagggtatccgggtgacgggagtccatgatcactgtaccgtacgcaccacgcagctgcgggatagcacgcagaacggcctcacgcagagtcccgccttgtttcagctcccagttcaccagatgggcaatcacttcggtgtcggtttcagaaacgaaggtatagccacgcgcttttagctcttcacgcagcggttcatggttttcgatgatgccgttatgcaccaccacaatgtgttcagaaacatgcggatgcgcattcacttctgaaggttcaccgtgggtcgcccagcgagtgtgagcaataccagtgccgccatgcagaggatgttcttccgctgcctgtgccagcatctggactttaccgaggcgacgcaggcgggtcatatgaccttctgcatcaacaacggccagaccggcagagtcatatccgcggtattccagacgacgtaaaccttcaagaaggatttctgctacatcacgttgcgcgatcgcgccaacaattccacacatagtttttgattccgatttatatcgttgtcggtcaacctgtatgcccgttttttcgggcgccccgagccttgtagagagtggggttatttttatagttactgcttgtgggagggagattatgttatctcctcatcccatgtgaccgggttagccggccagaatcactttttctttaccggacgacgccagccttctttctgagtctgcggcacacggctgatagctaatgcattttcgccgacattacgcgtcacagttgtacccgcagcaatggtcgcgcctttgcctactgttaccggggccaccagctgagtgtcggaaccaacaaacacatcgtcgccgataatggtcttaaatttattcgcaccatcgtagttgcaggtaatggttcccgcgccgatgttaacgttatcgccaatttccgcatcgcccaggtaagtcagatgaccagctttcgagcctttacccagacgcgcttttttcatctcaacgaagttaccgacgtgagcaccttccagcaactcagcaccaggacgcaaacgggcaaacgggccaatggtacaggccgctgccagattcgcatcttccacaacggtatacggactgatttcgcaatcatcgccaatcacgctgtttttaatcacgcaaccggtgccaattttcacgcgatgaccgagagtcacgttgccctcgatgataacgttagtatcaatttcaacatcgcgcccgtgagttagcgtaccacgcagatcaaaacgcgctggatcgcgcagcataacgcctgctaacagcagtttttcagcctgttcggactgataaacacgctccagacgggagagttgcaggcggttattcacgccttctacttcgcttaaacgttgcggatgaacggcgacgatttcacgcccttcctgatacgccagcgcaataatgtcggtgatgtagtattcgccctgagcattattgttggtcagcttcgccagccagcgtttcatatctgcgccgttggcaatcagaatgccggtgttgatctcctgaatctgacgctgctcgtcggtggcatctttgtgctcaacaatgccggtaactttgccgttttcacgggtgatacgtccataaccggtcggatcatccagtttcaccgtcagcagaccaatgccaccctgcggtttagcatcacgcagacgctggagtgtttcgacagagatcagcggcacgtcgccgtagagcattaaaatgtcttcatcatcggcaaagaaaggtgcggcctgctgcattgcatgacccgtacccagctgctctgcctgaagcacccagttaaggttgtcgtctttcagcgcctgttttagcagatcgccgccgtgaccgtacaccaggtgaacgtgcgctgcgcctaattcattcgcagcatcaatgacatgctgaaccatcgctttcccggcaagggtatgcagcactttcggaagatcggaatacatgcgcgtgcctttgcctgcggcaaggatcactacgctcatagcattattcaacatacgcgtcctgactgtaatttgagaacgaatttaaaccgcttcaccttgaaaaaactacatttttttcatcgtgaaatggacagaggataaattgttcaataacggattatccccgctgacgaaagcgccattttcgaccatcgtcacgccttttgtctgcagaaaattaaggcagtaccttaatttaagcgtcaggtggatgtttttgctcttatttcgatcaatgaataaacaggaaaacaggggggttttatatcagcaggatctatgtgaacgctattcaggacgggtcacacgcgcaaaaaaaagccagcctgtttccagactggcttttgtgcttttcaagccggtgttacatcgcttttttggtcaactcgataacgcgcagctgcgcgatcgctttggccagttccgcagacgcctgagcgtaatctacgtcgccgtgagagctgctaatgtgctcttcagccttacgtttcgcttccatggctcgcgcttcgtcgagatcctggccgcgaattgcggtgtcggccagaacggtcacgttgccaggctgcacttcaagaatgccgccagacagatagataaactcttcgtgaccgtgctgtttcacgatgcgaatcataccaggcttaatggcggtgagcagcggtgcgtggccagggtagatccccagttcaccttcgctacccgttacctggattttctcgaccagaccagagaacatttgttgctctgcgctgacgacgtccaggtggtaagtcattgccatatcaccctccgattaaggcgttaaagttttttggctttttccacagcttcttcgatggaaccgaccatgtagaacgcctgctccggcaggtgatcgtattcgccttccatgatgcctttaaagccacggatggtgtctttcagggagacgtatttacccggagaaccggtgaatacttctgccacgaagaacggctgggacaggaagcgctggatcttacgagcacgcgctaccaccagtttgtcttcttcagacagttcatccatacccaggatggcgatgatgtctttcagttcctgataacgttgcaggatggactgaacgccacgcgcggtgtcgtagtgttcctgaccaaccaccagcgggtccagctgacggctggtggagtccagcgggtcaacggccgggtagatacccagagacgcgatctgacggctcagtaccacggttgcgtcaaggtgcgcaaaggtggttgccggagacgggtcagtcaagtcatccgcaggtacgtatactgcctgtacggaggtgatagaaccagttttggtggaggtgatacgttcctgcagaacgcccatctcttccgccagggtcggctgataacctaccgctgaaggcatacggcccagcagtgcggatacttccgtaccggccagggtgtaacgatagatgttgtcaacgaacagcagaacgtcacgaccttcgtcacggaatttctcagccatggtcagaccggtcagagcaacgcgcagacggtttcccggcggctcgttcatctggccatacaccagggatactttgtcgataacgttggagtcggtcatttcgtggtagaagtcgttaccctcacgagtacgttcacctacgcccgcaaacacagagtaaccggagtgctcgatcgcgatgttacgaatgagctccatcatgtttacggttttacctacacccgcaccaccgaacagaccaactttaccgcccttagcgaacggacacatcaggtcgataactttgataccggtttccagcagttcctgagagtttgacagctcttcgtaggaaggtgctgcgcggtgaatcgcccaacgctcttcttcaccgatctcgcctttcatgtcgaccggttcacccagtacgttcatgatacggcccagagtcgctttacctaccgggacttcaatcgggtgttcgaggtcttttacatccagaccgcgacgcagaccgtcggaggaacccattgcgatggtacgtacgataccgccgccgagctgctgctgaacttccagcaccagacgctcactaccattttgcacctcaagagcatcgtacacgcgcggtacggcatcctgagggaattcgacgtcaactacggcgccgattacctggacaatctttccagtagccatcttaaatcctctacgaaataacctgtttaaaccgcggcggcccccgagacgatctcggtgagttcctgagtaatgctggcctgacgagctttgttgtataccaactgcagctctttaatcaggctgccgccattgtcggtcgcggctttcatcgccaccatacgggcggcctgctcgctggccaggttttcaaccacgccctgataaacctgagattcgacataacgacgcagcagggtatccagcaacgccttcggatcgggttcgtacaggtaatcccaggatttatgtttcagatcatcatcatctgatgccggtaacggcagcagctggctgatggtcggaacctgagacatggtgttaataaatttgttgctgacaatgtaaagcttgtccagacggccttcgtcgtaggcctgcaacatcacttttaccggaccgatcagttcggacagggaagggttatcccccatgccggtgacctgggcaacaacattgccgcccacggagttgaagaacgacacgcctttcgagccgatcattgcgaggtcgcattgaacgcctttgtcggtccaggtcttcatttccgccagcagttttttgaacaggttaatgttcaaaccaccgcacaaaccacggtcggtcgacaccaccaggtagcccacgcgtttaacgtcgcggtcttccaggtaagggtgcttatattccagattaccgtgtgcaaggtgaccaatcactttgcgcatggtttctgcataaggacggctggccgccatgcgatcctgcgatttacgcattttggaagcggcgaccatctccatcgctttagtgatcttttgcgtgttctggacgcttgcgatcttactacgtatctcttttgcgccggccatgagcttctcctcaatgccttgcggcctgccctaaggcaagccgccagacgttaccaggattgggttgctttgaaggaatcgaggatgcctttcagcttgccttcgatttcgtcgttgtagccaccggtctggttgatctcttgcatcaacggagcgtgatcacggtcgacgtaagccagcagagcggcttcgaagctgccaattttcgacagttcaacatccgccaggtaaccacgttctgctgcgaacagaaccagagactgctgcgcaacggacatcggcgcatactgtttctgtttcagcagttcggtcactttctgaccgtggtcaagctgcttacgtgttgcatcgtcaaggtcggatgcaaactgagagaacgctgccagttcacgatactgtgccagagcggtacggataccaccggacagttttttcatgatcttggtctgtgctgcaccaccaacacgggatacggaaatacccgggttaaccgcaggacgaataccggcgttgaacaggttggtttccaggaagatctgaccatcggtaatggagattacgttggtcggaacgaacgcagaaacgtcacccgcctgagtttcgataatcggcagtgcggtcagagaaccggttttccctttcacttcacctttggtgaaggcttcaacgtattcggcgttaacacgtgcagcacgctccagcagacgagagtggaggtagaaaacgtcgcccgggaatgcttcacgtcctggcggacgacggagcagcagggagatctgacggtaagcaacagcctgtttagacaggtcatcgtaaatgatcagcgcatcttcaccgcggtcacggaagtattcgcccattgcgcaaccggcatacggtgccaggtattgcagtgcagcggattcagacgcggttgctaccacaacgatggtgttagccagtgcgccgtgctcttccagtttacgtaccacgttagaaatggtggacgctttctggccgatagcgacatagatacatttgataccggaatcgcgctggttgatgatggcatcgatagccagtgcggttttacctgtctgacggtcaccgatgatcaattcacgctgaccacgaccgattgggatcatggagtcaacggctttataaccggtctgtaccggctgatctacggactgacgttcgataacgcccggagcgattgcttctacagcagagaagccgtcgtgatccagcggacctttaccgtcgattggtgcacccagagtgttaaccacacggcccagcaggccacggccaaccggaacttccaggatacggccagtacacttaactttcatgccttcggcaaggtcagcgtacggacccataacaaccgcacctacagagtcgcgctcgaggttcagtgcgatagcgtaacggttacccggcagggagatcatttcaccctgcatacaatcggccaggccgtgaatgcggataacaccgtcacttacagaaacaatagtaccttcgttgtgagcttcactcacaacattgaactgagcaatgcgctgcttgatcagttcgctgatttcggtggaattcagttgcatgctccagtccccttaagactgcaagacgtctgcaaggcgctcaagacgaccgcgtacgctgccatcaatgaccatatcacccgctcggatgataacgcctgccattacagacttatcgattttgcaattcagcttaactttgcgtgacagacgtttttccatcgcagcagaaattttcgcgagctgttgttcactcagtgcggcagcggaaatgacgtctacctcagcggtagcctcactcacggcacgcaggtgaataaactgctccagaacatccgggagcgcgttaagacgaccattttcagccataacccgaatcaggttctgaccgttttcgtccagttgctcaccacaaactgcgataaacgactcggcgagcgtttctggcgcaagcgcgccagagagaagctctgccatttgttcgtttttggttacctcggcggcaaacgccagcatgtcctgccagcgttctacactttggtgttcgacggcaaagtcaaaagctgctttggcgtaggggcgagctaccgtaataaattcagacatcagcccctccctccttacagttcagcgacaagtttatccacgatgtcgctgttagcagcttcatccacggaacgttcgatgatcttctcggcgccagcaacagccaggatagcaacttgcttacgcagctcttcacgggcacgtttacgctcggcttcaatttccgcctgcgcctgggccacgattttagtacgttcctgttctgcctcagctttcgcttcgtccagaatctgcgagcggcgtttgttcgcctgctcgatgattacctgggcttccgctttcgcttttttcagctggtcggtcgcgctggcctttgcaaggtcaaggtccttatgtgctcgttctgcggaagcaaggccgtcagcaatttctttttgacgtttttcgatggctgccattaatggcggccatacgtacttcatgcagaacagaacgaacaggacaaacgcgatggcctggccgaggattgttgcgttaagattcacagcacaatgcctctatttagttaacgttctgatattgctctttaaataaaagcaacgcttactacgcgacagcgaacatcacgtacagacccagacctacagcgatcatcgggatagcatccaccagacccataacgataaagaactgagtacgcagcagaggaatcagatcaggttgacgcgctgcgccttccaggaatttacccccgaggatgccgataccgatcgcagcaccgattgccgccagacccatcatcacagcggcagccatgtacagcagatccatattcaggttttccatgacagtctccagtttgtttcagttaaaacgtagtagtgttggtaaattaatgttcttcagacgccatcgacagatagacgatcgtcagaaccatgaagatgaaggcttgcagcgtaatgatcaggatgtggaaaatggcccacggcacattcaggatccactgtgaccaccacggcaacagaccagcaatcagaatgaaaatcagctcaccggcatacatgttaccgaacagtcgcaaaccgagtgaaactggtttggacagcaggcttaccccttcaaggattaagttgacaggaatgaacgcccagtgattgaacggctgcagcgtcaactctttcgtgaagccgccgatgcctttcattttgatgctgtagaacagaatcaggataaatacgcccagtgccatagacagcgttacgttcacgtccgcagacggaaccacacgcagtgcaggcagacccagtacatgttcagcaatgtacggcagcaggtcgataggcagtaaatccatcaggttcatcaggaatacccagacgaagatcgtcagggccagcggagcaatcagcttgcttttgccatggtacatgtctttcacgctaccattaacaaagccgatcaccagctcaatcgcggtctgaaacttacctggcacaccgctggtcgcctttttggctacgctacggaataaaaccaagaacaacagacccagcaccaccgagaagaacatggagtcaatattgattgtccagaaggtggctggggggttttgtggatccaccagcgagaatgtacgcaggtccagctgaaggttattcaggtggtgtcctatgtaatcctgcggcgtcatattttctgaagccatgatgccttttaccctttgttgttaattacagccggtgccagtatctgaaccaccagcaccaaaacccacgtaacgatcagcggcaagaataccgcctttaaaaccgccaacgccaccaccagtaacaccaacatcgccagaactttgaaagcttcgccaaatgcgaatgtccaggccacccggcctttcgctggtgtatgcgcctggtgacgccaggcaaatatcataaacaaaacgttaggcagaaagactgccaggcccccgcttattgcagagacgccccagaaggggtctttgaggctgaacagcaatccacttgctatcaccaccagtaactgaacgagcagaagcttccgagcaacgtttcgactcacgagcgacacagacatcacgtttttcactcctgctcccttcgaggtatgccgcgtgtcgtataaaactttctttaaggcttagagtcaagcatcaaaaagcggtcaaattatacggtgcgcccccgtgatttcaaacaataagtagccaaaaggtgaataaatgtttaaatatttttccagtgcatacaattgcgacttttctgctaaccctgttcgatcatgaaaaactgtaaataacgcgtaaacactggtgataaagcgtgcttcagatcacatattgcgcatgttcgcgcacagcatatttatttacttggcaaatgatgcctttgcaagtttatgatatttcagtctaaaaacagatactgttttaataaatgacatttacacaacaaaaaccacccattgacatttttaataatgttttaacagccaatgatggttcttagcgccgatttttagcagactgatattttcactaatgacttattttctgcttaccaaaaaaagccacgttatcttgttgatgcaaaagagtgaacgtggcgttaaatgtaaccagttatatcagtagaaaacctggttgttgttaacagtctaaccggtcaattttttatgatttttttgataaaaattaaattttatttgctttaatcaccaccagatgacgttcgccatccagggctggaacctgaagtttaaccactgattcgacctgatattcttcgggcaacaaagcgatttcatcttccggcatttgccctttcagcgcgtagaaacggccttgctcaccaggaagatggtggcaccagctcaccatatcgttcagagaggcaaaagcgcggctaattacgccatcaaatggcggctctgaaggaaactcttctaccctgctctgtactggttcaatattctccagtttaagctcatgttgcacctgacgaaggaaacgcacgcgtttaccaaggctatccaacagagtgaaatgggcttcaggacgcacgatagagagtggaatgcctggcagtcctggtccggtgccgacatcgataaaccgttcaccttgcagatacggtgccaccacaatgctatcgagaatatggcgtaccagcatctcattaggatcgcggaccgaagtcaggttgtacgctttgttccatttatgcagcatattcacgtaggcaataagctggtttttctggtgatcggtaagcgaaatacctgcgtctttcagcagtaaggagagtttgttgagcacggtgattacctgttcttgatgcgttgcctggtaagcgggtgcttaccaggcatttttaatgtgttatgcgctacgacgcagcataccctgttttttcagccacaccagcagaatggagatggccgcaggcgtgacgccagaaatacgtgaagcctggccgatagaggccggtttgtgatcgttaagtttggcgatcacttcgttagaaagaccggatacctggcggtaatccagtgtcgcgggtagcagggtgttctcgttacgcagctgcttttcgatctcatcttgctggcgcgcgatataaccttcgtatttaacctgaatctcaacctgttccgccgcctgttcgtctgtcaacgcaggggcaaacggcgtcagcgtggttaatttttcataagtcatttccggacgacgcagcagatcttcaccactggcttcacgggaaagcggcgcagtcaggtgagcattcacttcggctgcagcttccgccgacggggttacccaggtcgatttcagacgctgacgctcacgctcgatattctcaagtttctcgttaaagcgcgcccaacgttcgtcatccaccaggcccagttcacgaccgatttcagtcaaacgcagatccgcgttatcttcgcgcagcatcagacgatattctgcgcgcgaggtaaacatacgatacggttctttggttcctaaagtgcacaggtcatcaaccagtacgccgagatacgcctgagaacgcgccggagcccaaccttctttgtcagcagacagacgggcagcgttaagaccggccagtaaaccttgcgcagcggcttcttcgtaaccggtagtgccgttaatctgaccagcaaagaacagcccctggataaacttgctctccagcgtcggtttcaggtcgcgaggatcgaagaagtcatactcaatggcataacccggacgcacgatcttcgcgttttccatcccctgcatagagcggacgatttgcatctgcacatcgaacggcaggctggtggagataccgttcggataaatttcgttagaggtcagtccttccggttcaaggaagatctgatgctgatttctgtcggcgaagcgcatgactttgtcttcgatcgacgggcagtagcgtgggccgacaccttcgatcacccctgcatacattgggctacgatcgaggttactgcggatcacatcatgggttttctcgttggtatgagtgatataacacggcacctgctggggatgctgggacgcattgcccataaacgagaataccggcattgggttatcgccatgctgttgcgccagcacactaaagtcgatagttcgagcatcaatacgcggtggtgtcccggttttcagacgaccaacgcgcagcggcagttcacgcaaacggcgagaaagcggaatggacggcggatcaccagcacggccaccgctgtaattatccagaccgatatgaattttaccgtcgaggaatgtcccaacggtgagcacgacggctttggcacggaacttcagtcccatttgggtaacagcaccgaccacgcgatcgttttcgacaataagatcttcaaccgcctgctggaagatcatcaggttcggttggttctccagcgccgtacgtaccgcctgacggtagagcacacgatccgcctgagctcgggtagcgcgaaccgccggtcctttgcttgcgtttagtatcctaaactggatacccgcttgatcgatcgctttcgccatcagaccgccgagtgcatccacttcttttaccagatgtcccttcccaataccgccgatcgccgggttgcagctcatctgccccagagtgtcgatattgtgtgtcaaaagcagagtctgttgacccatacgcgccgcggccatcgcggcctcggtgcctgcatgacccccgccaatgatgatgacgtcaaaaggatccggataaaacatggtgattgcctcgcataacgcggtatgaaaatggattgaagcccgggccgtggattctactcaactttgtcggcttgagaaagacccgggatcctgggtattaaaaagaagatctatttatttagagatctgttctattgtgatctcttattaggatcgcactgccctgtggataacaaggatccggcttttaagatcaacaacctggaaaggatcattaactgtgaatgatcggtgatcctggaccgtataagctgggatcagaatgaggggttatacacaactcaaaaactgaacaaccgttgttccttggataactaccggttgatccaagcttcctgacagagttatccacagtagatcgcacgatctgtatacttatttgagtaaattaatccacgatcccagccattcttctgccggatcttccggaatgtcgtgatcaagaatgttgatcttcagtgtttcgcctgtctgttttgcaccggaatctttgagttctgcctcgagtttatcgatagccccacaaaaggtgtcatattcacgactaccaataccgattgcgccaaagcggaccgcagaaagatcgggcttctgttcctgcaatgcttcatagaaaggagaaaggttgtccggaatatctccggcaccgtgggtggagctgataatcagccagatccccgaggcagataaatcttccaacagcggaccgtgcagcgtttcggtggtaaaacccgcctcttccagcttttcagccaggtgttctgctacatattcggcaccgccgagggtgctgccgctgataagagtgatatctgccataaaccgccacctttattaagagtggcgtattgtacgccgtgaacgcgttgggatctacctgtggaaaagtatgggattaaaaaagccgattatggcttgatggtacgcatgatcgggttttgcaggacgatcaatgtctcggtggactgaatttcatcaattgtttggatcttgttgataagtacatgctggagagcgtcgatcgaacggcacatcacttttataaagatgctgtagtggccggttgtgtaataggcttcagtgacttcatcaaggctttccagctttgccagcgcggaagggtagtctttggcgctctttaatataatgccgataaagcagcctacgtcataaccgagctgcttcgggctgacatcaatacgcgccccggtaatgatccccgcctgcttcattttctctactcgaacgtgaatcgtccccggactgacgccaaattgtttcgccagttcggcgtaagcggtgcgcgcattgcccattaatgcttccaggatgccacggtccagattgtcgatcagataattttccataggattttcttatgcggattgatgattcattctattttagccttcttttttaatgaatcaaaagtgagttaggctttttattgaatgattattgcatgtgtgtcggtttttgttgcttaatcataagcaacaggacgcaggagtataaaaaatgaaaaccgcttacattgccaaacaacgtcaaattagcttcgtgaaatctcacttttctcgtcaactggaagaacgtctggggctgatcgaagtccaggcgccgattcttagccgtgtgggggatggcacgcaggataacttgtcgggctgtgaaaaagcggtgcaggtaaaagtgaaagctctgcctgatgcccagttcgaagtggttcattcactggcgaagtggaaacgtcagaccttagggcaacacgacttcagcgcgggcgaagggctgtacacgcacatgaaagcccttcgccccgatgaagaccgtctttctccgttgcactcggtctatgttgaccagtgggactgggaacgcgtaatgggcgacggtgagcgtcaattctcgactctgaaaagcacggtagaggcgatctgggcgggaattaaagcaaccgaagctgcggttagcgaagagtttggcctggcaccgttcctgccggatcagatccacttcgtacacagccaggagttactgtctcgttatccggatcttgatgccaaagggcgtgagcgggcgatagcgaaagatcttggcgcggtattccttgtcgggattggcggcaagctgagcgatggtcatcgccacgacgtgcgcgcaccggattatgatgactggagcaccccgtcagagctgggccatgcgggtctgaacggcgatattctggtgtggaacccggtactggaagatgcgtttgagctttcctccatggggatccgtgtagatgccgacacgctgaagcatcaactggcgctgaccggtgacgaagatcgcctggagctggagtggcatcaggcgctgctgcgcggtgaaatgccgcagaccatcggcggcggtatcggccagtctcgtttgactatgctgctgctgcaactgccgcatatcggccaggttcagtgtggagtatggccagctgctgttcgcgagagcgtcccttctctgctgtaataatttatcgccgccagcgtctgagcaggcggcttcgcatcccggtatcaaagcgccagatatgatcgaaaatgcgcatgatgccgggtttgccgtgtgccgacatcgccacggcatgaaagcgatgctgatgtacccgctgcagctctttcactttactcgtcacgtcgtcaggcaaccgctgagcgataaaatcagaaatcaccaccgcatcggcatcaaaccattccctgctttgcaagcgttccataatggcgcgaaaacaactggcaagatcggtgccgccacgaaactgctggcttaaaaaacggattgcttgttcgatgccttgtgggcctgaaagctcataacggacgatctcggtggaaaatagcataatatagcagcgccggttttctgcgagagcaatgcgcatcaaggccaggcagaacgctttcgcacactgttcattaaagccgcccattgagccggaagtatccacacagacaataaacggcccgcgcggctgttcatcgtaatctttatgtaccaccggacgttcgatcactttttcacgccacgactcaccgtgcaggcgataggtgagcaactgtttttccaccagccgacggtaaaactcatactccagttccgttatccctagtgtcgccagttctggcggcaggagacgtaaaatatcatcgctttgttgcagaccatcaacctgctcaggaaccgtcgccggttcgcgcaccatggtgcggaaggtttccatctgcgcatcgttgcgcggtattgatttggcttcccgagaacgccccagctgctctgccaggcgtttcagttccggctgttcgttaagaaattcaccgtatttcacaatcaactgatagtcgccacgtttaagctggccggcgctcatatcccacagacgaccagctgcggtattgttatctgcgagaatcggttcaagttgtccgctcagcgtcatgcgttcctgaacttcacttaacagttgttcgcgttcttcttctaatagctgttgatttaacgtcgttgcttgcacgatcagacttaaacgccaacgctggagaaaaagtgtgtgtaacgctgaagtgatcgcgctgttagcatcaaccaactgtcgggcttgttctgcccatggggaattcagacgatgcagtaagtccaggatctgtggtagctgcacaataaactgcggcgtggagaggagctggctttgctgatagcacatcacctcttcggtgagttctggcgggactcgggcatctttcagccgactgcgcagcgcctcacgccagcggggaacatcatcagtgattgctgccttcaggcgtgggaatttttcaaagaagactgccagctgcggtgaggccagcagcgcgatgatcatctcttcgatcaatccctcttcgctgacggccagcatcacattaagcgtatccagcgttagcattgttgtgcctggcgaatctgtgcactgacatcctgtaggctggcttcaatgcgacctaaccagtcgccagggataaacagacatttttgctgttcgctgaataaagcgtgttgcttacgccagtcgctttcaagctcttccagttgttgttttatttcacctggcagaccttcagccgatgaaccgggaagtgccagcgtactgccttgtaaacttacatcgcgtacaacaagatgttgggcgctatccacttccagattcaatttctgggcaaagccgataccgttcagtttgccgcgaatttcaccacctttactcagccactgttccagcgcgttacgctcaaaggagatatgaaccacttccatatcatgcaattttaacggtttttgcagcagcagagtcagagtggaagcagtaacgttaacaggaagttgatactgctgacgacggctgaaaatgccgcccagacgaattaccgttaaggctgttttatcgctttgttgctgctggagttgcaggtgacgttgcacaatcgcgccaaggcgagtcaacatcccttgctgttgccaggcgtgaccggtcatcaatacatcaatttgttgttgtatcaaattcaggctttgcgcgtcataccacaggcaatctttcagcaaaatgagatctaccggggcaacagcactgcgaccgctaaaaaaggcgctggcctgtaataatcggatcgcttttttccagcgacgatccgagacataaggcgcatccggtaatttatccagttgctggcgcagcataaaaatcagctcaaatacatgatcgggcagcgtaatttcaccaatctctttctgccagcgttcatattcttcatctgtgacctgcaaggcatcaggaaccggattgtcgttttcatcctgttgactggtcagcatggagcggaaattcgctttatcctgcactttatctaaccacagacgaatcagcatgcggtcatataacgcttccagactgctgtctgcttccggcagctcgttggaggccgccaccagcagacgcatcgggattttttctacgtgtgcaccgttgcggaactggcgctcgttaatggcggtgagcaaggtattaagaattgccgggcccgctttccagatctcatccagaaagacaatttctgcttccggcaggtaaccgctggttaaacgttcatagcgcccttcatcttttagcgcctgaatagaaaggggaccaaaaacttcttccggcgtggagaagcgggtcatcagatattcaaacgcgcgggcattctgaaaggcgaattttaagcgccgggcgatcaaacttttggcaatacctggcgggccaaggaggaacacactttcaccacttaatgccgctaataaacacaagcggatggcgtggctacgttcataaagccccttttccaacgaactgctcaggcgggaaattctttccgctaataaatgagggtgagccataatgaagtggcgtcctttcgtcaaaagttctgcgtaaattgcgagtatagacgtttcttgctggtggctaaaatagtctcaaagggggggtatttttctttgagccaggttaatgtggccgcatttaggagtacgattttgccgttaatcgtgcatactgtgcgcttttttgtgggccaagggactaagcacacatttcatatttcaacgaaagactagtctatgagcactgataataagcaatcattgcccgcgattaccctcgcggcgattggagttgtctacggcgatattggtaccagcccgttatatacacttcgtgaatgtttgtccggccagtttggttttggcgttgaacgcgatgccgtgtttggctttttatcgctgatcttctggctgctaatctttgtggtttccattaaatatctcaccttcgtgatgcgggcagataacgccggtgagggggggatcctgacgttgatgtcgcttgccgggcgtaatacgtcggcgcgaaccacatcaatgctggtgattatggggctaatcggcggcagctttttctatggtgaagtcgtcataacacccgctatttcggtgatgtcagccattgaaggtctggaaatcgtcgccccgcagctggatacctggatagttcccctctcaattatcgttctcactttattatttatgattcaaaaacatggcacggctatggtcggtaagctgtttgcgccgatcatgctgacctggtttttgattctggcaggactggggttacgtagcattattgctaacccggaagtgctgcatgcgctgaatccaatgtgggcggtgcatttcttccttgaatacaaaacggtttcttttattgcattaggggcagtggtgttgtcgattacgggggtcgaggcgctgtatgctgatatggggcactttggtaagttccctattcgcctggcgtggttcaccgtcgtattaccttccttgacccttaattacttcggtcagggagcgctgttgttaaagaacccggaagcgattaagaacccgttcttcctgttggcaccggactgggcgctgatcccgctgctgatcatcgccgcactggcgacggtaattgcctcgcaggcggttatctctggcgtcttctcattgacgcgtcaggcggtacgtctgggatatttgtcgccgatgcgcattattcacacctccgaaatggagtcagggcaaatctatattccgtttgtgaactggatgctctatgtcgcggtcgtgattgtgattgtcagctttgagcactccagcaacctggcggcggcgtacgggattgcggtgaccggaaccatggtgctgacgtctattctctcgactaccgtggcacgtcagaactggcactggaataagtattttgttgcgctgatcctgattgctttcctttgtgtcgatattccattgttcaccgctaacctcgataaactgctctccggcggctggttgccattgagcctcggtactgtgatgtttatcgtgatgaccacctggaagagcgagcgtttccgcttgctgcggcggatgcatgaacatggtaactctctggaagcgatgattgcttcgctggagaaatcaccgcctgttcgcgtgcccgggaccgcggtgtatatgtcgcgtgcaatcaacgtcattccctttgcgctgatgcataaccttaaacataacaaggtattgcatgagcgggtgattctgttaactctgcgtaccgaagacgcgccatatgtccataatgtccgtcgggtacagattgaacaactgtcgcccactttctggcgcgtggtggcaagttatggttggcgagaaacgccaaacgtggaagaagttttccaccgctgcggtctggaaggattaagttgccggatgatggaaacctccttctttatgtcgcatgagtcgttgatcctcggcaaacgcccgtggtatttgcgtctgcgcggcaagctgtacttgctgctgcaacgtaatgcgctgcgtgcaccagatcaatttgaaattccgccaaacagggttatcgaactgggtactcaggtcgaaatctaacgccagacgcctcctttctccataagggggcgtttttgttttcatggttaatcaccatgtaaaacgtttcgaggttgatcacatttccgtaacgtcacgatggttttcccaactcagtcaggattaaactgcgggtcagcgaaacgtttcgctgatggagaaaaaaatgaaaaaaggcaccgttcttaattctgatatttcatcggtgatctcccgtctgggacataccgatacgctggtggtgtgtgatgctggtttacccatccccaaaagtacaacgcgtatcgatatggcattaacccagggtgtaccttcttttatgcaggtgctgggcgtcgtcacaaatgaaatgcaggtcgaggctgccattatcgcggaagagatcaaacaacataatccgcaactccacgaaacgttgctcactcaccttgagcagctgcaaaaacaccagggaaataccattgaaattcgttacaccacgcatgaacaattcaaacaacaaaccgcagaaagtcaggcggtaattcgcagcggagaatgttctccgtatgcgaatatcattctctgtgctggcgtgacgttctgaggccgtcatggaagcattacttcagcttaaaggcatcgataaagccttcccgggcgtaaaagccctctcgggcgcagcgttaaatgtctatccgggccgcgtgatggcgctggtgggcgaaaacggcgcgggtaaatccaccatgatgaaagtgcttactggtatctatgctcgcgatgccggcacgcttttatggctggggaaagaaacgacatttaccgggccgaaatcttcccaggaagccgggattgggattatccatcaggaactgaacctgatcccgcagttgaccattgccgaaaacattttcctcggtcgtgagtttgttaatcgctttggcaaaattgactggaaaaccatgtatgccgaagcggataaattgctggctaaacttaacctgcgctttaaaagcgacaagctggtgggcgatctttccatcggtgaccagcaaatggttgaaatcgccaaagtgctgagctttgagtcgaaagtcatcattatggatgaaccgaccgatgcgctgaccgataccgaaaccgaatccctgttccgcgtcatccgcgagctgaaatcgcaaggccgcggtattgtctatatctcccaccgcatgaaagaaatcttcgagatttgcgatgacgttaccgtttttcgtgatgggcaatttattgctgagcgcgaagtggcatcactgaccgaagattcgctgattgagatgatggtgggtcgcaagctggaagatcaatatccgcacctggacaaagcgccgggagatatccgcctgaaagtcgataatctctgcggacctggcgttaacgatgtctcttttactttacgcaaaggcgaaattcttggcgtctctggtttgatgggcgcaggtcgtaccgaactgatgaaagtgctctacggcgcactaccgcgcaccagcggttacgtcaccctggatgggcatgaagtcgttacccgttcaccgcaggatggcttggcaaacggcattgtgtatatctccgaagaccgtaaacgtgacggtttagtgttgggcatgtcagtaaaagagaacatgtcgctgacagcgctgcgctacttcagccgcgctggcggcagtttgaagcatgccgatgaacagcaggctgtgagtgatttcattcgtctgtttaatgtgaaaactccgtcgatggaacaggcaattggtctgctttccggtggcaatcagcaaaaagtggcgattgcccgcggtctgatgacacgccccaaagtgttgatccttgatgaacctacccgtggcgtagatgtcggcgcgaaaaaagagatctatcaactgattaaccagttcaaagccgatggcttgagcatcattctggtgtcatcggagatgccagaagtattaggcatgagcgatcgcatcatcgtcatgcatgaagggcatctcagcggggaatttactcgtgagcaggccacccaggaagtgttaatggctgccgctgtgggcaagcttaatcgcgtgaatcaggagtaaaaaaatgacaacccagactgtctctggtcgccgttatttcacgaaagcgtggctgatggagcagaaatcgcttatcgctctgctggtgctgatcgcgattgtctcgacgttaagcccgaactttttcaccatcaataacttattcaatattctccagcaaacctcagtgaacgccattatggcggtcgggatgacgctggtgatcctgacgtcgggcatcgacttatcggtaggttctctgttggcgctgaccggcgcagttgctgcatctatcgtcggcattgaagtcaatgcgctggtggctgtcgctgctgctctcgcgttaggtgccgcaattggtgcggtaaccggggtgattgtagcgaaaggtcgcgtccaggcgtttatcgctacgctggttatgatgcttttactgcgcggcgtgaccatggtttataccaacggtagcccagtgaataccggctttactgagaacgccgatctgtttggctggtttggtattggtcgtccgctgggcgtaccgacgccagtctggatcatggggattgtcttcctcgcggcctggtacatgctgcatcacacgcgtctggggcgttacatctacgcgctgggcggcaacgaagcggcaacgcgtctttctggtatcaacgtcaataaaatcaaaatcatcgtctattctctttgtggtctgctggcatcgctggccgggatcattgaagtggcgcgtctctcctccgcacaacccacggcggggactggctatgagctggatgctattgctgcggtggttctgggcggtacgagtctggcgggcggaaaaggtcgcattgttgggacgttgatcggcgcattaattcttggcttccttaataatggattgaatttgttaggtgtttcctcctattaccagatgatcgtcaaagcggtggtgattttgctggcggtgctggtagacaacaaaaagcagtaataacgactacaggacatcttgaatatgaacatgaaaaaactggctaccctggtttccgctgttgcgctaagcgccaccgtcagtgcgaatgcgatggcaaaagacaccatcgcgctggtggtctccacgcttaacaacccgttctttgtatcgctgaaagatggcgcgcagaaagaggcggataaacttggctataacctggtggtgctggactcccagaacaacccggcgaaagagctggcgaacgtgcaggacttaaccgttcgcggcacaaaaattctgctgattaacccgaccgactccgacgcagtgggtaatgctgtgaagatggctaaccaggcgaacatcccggttatcactcttgaccgccaggcaacgaaaggtgaagtggtgagccacattgcttctgataacgtactgggcggcaaaatcgctggtgattacatcgcgaagaaagcgggtgaaggtgccaaagttatcgagctgcaaggcattgctggtacatccgcagcccgtgaacgtggcgaaggcttccagcaggccgttgctgctcacaagtttaatgttcttgccagccagccagcagattttgatcgcactaaaggtttgaacgtaatgcagaacctgttgaccgctcatccggatgttcaggctgtattcgcgcagaatgatgaaatggcgctgggcgcgctgcgcgcactgcaaactgccggtaaatcggatgtgatggtcgtcggatttgacggtacaccggatggcgaaaaagcggtgaatgatggcaaactagcagcgactatcgctcagctacccgatcagattggcgcgaaaggcgtcgaaaccgcagataaagtgctgaaaggcgagaaagttcaggctaagtatccggttgatctgaaactggttgttaagcagtagttttaatcaggttgtatgacctgatggtgacataaatacgtcatcgacagatgaacgtgtaatataaagaaaagcagggcacgcgccaccctaacacggtggcgcattttatggacatcccgaatatgcaaaacgcaggcagcctcgttgttcttggcagcattaatgctgaccacattcttaatcttcaatcttttcctactccaggcgaaaccgtaaccggtaaccactatcaggttgcatttggcggcaaaggcgcgaatcaggctgtggctgctgggcgtagcggtgcgaatatcgcgtttattgcctgtacgggtgatgacagcattggtgagagcgttcgccagcagctcgccactgataacattgatattactccggtcagcgtgatcaaaggcgaatcaacaggtgtggcgctgatttttgttaatggcgaaggtgagaatgtcatcggtattcatgccggcgctaatgctgccctttccccggcgctggtggaagcgcaacgtgagcgtattgccaacgcgtcagcattattaatgcagctggaatcaccactcgaaagtgtgatggcagcggcgaaaatcgcccatcaaaataagactatcgttgcgcttaacccggctccggctcgcgaacttcctgacgaactgctggcgctggtggacattattacgccaaacgaaacggaagcagaaaagctcaccggtattcgtgttgaaaatgatgaagatgcagcgaaggcggcgcaggtactgcatgaaaaaggtatccgtactgtactgattactttaggaagtcgtggtgtatgggctagcgtgaatggtgaaggtcagcgcgttcctggattccgggtgcaggctgtcgataccattgctgccggagatacctttaacggtgcgttaatcacggcattgctggaagaaaaaccattgccagaggcgattcgttttgcccatgctgccgctgcgattgccgtaacacgtaaaggcgcacaaccttccgtaccgtggcgtgaagagatcgacgcatttttagacaggcagaggtgacgcttggctacaatgaaagatgttgcccgcctggcgggcgtttctacctcaacagtttctcacgttatcaataaagatcgcttcgtcagtgaagcgattaccgccaaagttgaagcggcgattaaagaactcaattacgcgccatcagctctggcgcgtagcctcaaactcaatcaaacacataccattggcatgttgatcactgccagtaccaatcctttctattcagaactggtgcgtggcgttgaacgcagctgcttcgaacgcggttatagtctcgtcctttgcaataccgaaggcgatgaacagcggatgaatcgcaatctggaaacgctgatgcaaaaacgcgttgatggcttgctgttactgtgcaccgaaacgcatcaaccttcgcgtgaaatcatgcaacgttatccgacagtgcctactgtgatgatggactgggctccgttcgatggcgacagcgatcttattcaggataactcgttgctgggcggagacttagcaacgcaatatctgatcgataaaggtcatacccgtatcgcctgtattaccggcccgctggataaaactccggcgcgcctgcggttggaaggttatcgggcggcgatgaaacgtgcgggtctcaacattcctgatggctatgaagtcactggtgattttgaatttaacggcgggtttgacgctatgcgccaactgaatcgccacggataatctagacacttccgagccgttgataatactggttttcatattctgtcggtgacatctgttcgctagaaccatgccgacgcttactgttataaaacatttcgatgtaatcaaaaatatcactgcgggcttcttcccgcgttccgtagatctttttctttatccgttcacgtttcaacaactggaaaaaactttctgcaaccgcattatcatggcagttaccgcgacggctcatgctaccctccaggccgtgtgatttcaggaacgactgccactcatggcttgtgtactgactgccctgatccgaatgaaccagcacctgtttttcgggattacgccgccatacagccatcagcagtgcgttcaggacaatgtcctttgtcatccgggattgcatggaccagccgataattttgcgtgagaacagatcaacaacaacggcaagatacagccagccttcgtgggtcctgatgtaggttatgtccgttacccaacgctcatcaggagcatccggattgaactgtcgctggagcctgttgggtgacacgatactggcctcgcctttacgtgcccgcgggcttcggtatccgacctgagcctttattccgacacgtttcatcagtctccagactctgtttactccgcactgttgcccgctgtcacgcaaatccagatggattttgcgataaccatagacgcatcccgattccagccagaactgtttaatctgtcctgtcagtctcaggtctgcctgatggcgttgtgaatgcggctgctgaagccaggcgtaaaaaccactgggatgaacatccagcacccgacagagcaggcgaacaggccagcaacaggagttgtcacggataaaggcgtacctcagtcggacagctttgcgaagtacgccgcggctttttttaatatgtcccgttcgtcggtaacccgtttcagctctttctggagacggcggatctcggcctgagcatctgactgttctttattagtggaagaatccggaccgtacttctttatccaggcataaaggctgtgggtggtgatatcgagacgtgttgcaacgctggcaacagaataaccgcgatcaacaacctgtttgactgcttcagttttaaactcttcgggataacgcttaccgctcatgggcacctctctttaagccatcttaaatgactctgaggtgtctgttaaacccgtggcgattcaaactgctatcacatccgctgcgtcctcaggccgtctttaccggaaatgacgctatggctgttggcgtttaccaggcgttatatcaggcagagttacaggttccgcaggatatcgcggtgattggctatgacgatatcgaactggcaagctttatgacgccaccattaaccactatccaccaaccgaaagatgaactgggggagctggcgattgatgtactcatccatcggataacccagccaactcttcagcaacaacgattacaacttactccgattctgatggaacgcggttcggcttagatttacgctgtcttttgatcaaattattaccatcggttgttttcagaagcatgaacattgctgctgaagcaacagtaataatgcccattgtgataaacgtatagtggaattgttcgacagtcgttgtgccttccattccttcataaacgcgaaggacggccgcacttatagcaacgcctaaactgatagacagttgctgcgtgaccgccagaacactgttaccgctgctggcgttgtcatcggtcagatcggcaagtgtgatggtattcatcgcggtaaactgcgtcgacatagccatccctaatataaacaacggcaagatcagcatccatatcgccattgccggtgattgcaaagagaactgagcgatcattagcccaataatcaccgtgatccccactaatgtatggcgatagcccagacgacgtaagacttgggtaaccatcgattttgcaataatggaacctaacgctgtcggcgccatcatacagccggcaataaacgcctgataaccaaatcctacctgtaacatcaatggcataaggaacggtacacagccggtccccagacgggttgcaatattgcctacgataccgatcgagaaagtgcgggttttaaataaatctaatgaaattaatgggtttggcgtgcgtcgtgcatggagaatatagagaagcagtaacccgatgctggtgacaattaccgtcaaggcaatccagctggcgacaatcttttccccgaatagctctattccgcttgagaagagaacaaggctgaggccaaacaacaaaaagccagtgatatcgaatctgcgtcgtgcggtggtgaaattgggcatatgtttgcgcgcgtaaagaaggcctgcaatacctatggggatattgattaaaaatatccagtgccaggttgcccaggtgaccagcacgccgccaagaacggggcctaaaattggccccaccagacccggcatggcgacaaaattcaatactggaagaagttcattacgaggataagcgcgcagtaaggccagccgagcaacaggcatcatcattgcgccgcctatcccctgaataacccggaagacaaccagctgtggtagcgaattagaaagtgcgcaggccagagaacccaatgtgaacagactcacggcaagggtaaaaatgcgacgcgtaccgaagcgatcggctagccatccgcttaccggaataagcatcgccaccgtcagcgtataactgatgatggctgattgcatcgcgagaggagaacgattaaggctatgagcgattgcgggtaaggcggtattcagaatagtggcatcaagtgcctgcatgaagaaggccatcgccgcgatccacggcaaacccgccatactgcgcttctttttatcgctcattcaatgtcctgttatcgggttgtcacgtatcaggtgagcgtagcagcgcctgacaagctttaaatgccgcgtcgccatcgctttggacaatcgcatcgacaatcgcctggtgcagatccagctttatcactgtgtcgctggtaattgacgtgaagtaagtgtgataaaccgaatggaatagcgaggcgaatgaggtcaaaaacggattggcgctcatttcatagatatgctcatgccaggccatatctacttcgatccagcgttcacggcgaaagttctcttttaatgccgccatttcggccattaacgtattgagatgcgccttctgttccgcggtgccaaccgttgcagccagtaggcaagcttgcggctccagacagatacgcataaccagaaagtgatcgatgacctgatgaaagttctcttctgtcatccaccaggtaagcaattcctgatcaagaaaattccagtttgattgtggcatgacccgggtaccaattcgcggtcgcggtaaaaccatcccttttgccgttaacgttttgaccgcttcgcgtaccgctgtacgactcactccaaattgctcgcccagctcaatctcaccaggcaaaatggtgccgggttcatattcaccttttaagatgcgttgcgccagcttctcagccagaacatacgaaaggtttttctgtgcagctaactgttgtgcgcttaaaggcattactaatcttcctttttctttttattcctccttagtatgccaccaggaagtgtgattacggttgcaaaaacggcaaattgcttgttttatggcacattaacggggcttttgctgaaaaaatgcgcggtcagaaaattattttaaatttcctcttgtcaggccggaataactccctataatgcgccaccactgacacggaacaacggcaaacacgccgccgggtcagagaagttctcctgagaacttcggcagagaaagcaaaaataaatgcttgactctgtagcgggaaagcgtattatgcacaccccgcgccgctgagaaaaagcgaagcggcactgctctttaacaatttatcagacaatctgtgtgggcactcgaagatacggattcttaacgtcgcaagacgaaaaatgaataccaagtctcaagagtgaacacgtaattcattacgaagtttaattctttgagcatcaaacttttaaattgaagagtttgatcatggctcagattgaacgctggcggcaggcctaacacatgcaagtcgaacggtaacaggaagcagcttgctgtttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgttctttgcagtgctcacacagattgtctgatagaaagtgaaaagcaaggcgtcttgcgaagcagactgatacgtccccttcgtctagaggcccaggacaccgccctttcacggcggtaacaggggttcgaatcccctaggggacgccacttgctggtttgtgagtgaaagtcacctgccttaatatctcaaaactcatcttcgggtgatgtttgagatatttgctctttaaaaatctggatcaagctgaaaattgaaacactgaacaacgagagttgttcgtgagtctctcaaattttcgcaacacgatgatgaatcgaaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgcgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaactcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagcctgtgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagtccctcgcggatggagctgaaatcagtcgaagataccagctggctgcaactgtttattaaaaacacagcactgtgcaaacacgaaagtggacgtatacggtgtgacgcctgcccggtgccggaaggttaattgatggggtcagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttgacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgaccctttaagggtcctgaaggaacgttgaagacgacgacgttgataggccgggtgtgtaagcgcagcgatgcgttgagctaaccggtactaatgaaccgtgaggcttaaccttacaacgccgaagatgttttggcggatgagagaagattttcagcctgatacagattaaatcagaacgcagaagcggtctgataaaacagaatttgcctggcggccgtagcgcggtggtcccacctgaccccatgccgaactcagaagtgaaacgccgtagcgccgatggtagtgtggggtctccccatgcgagagtagggaactgccaggcatcaaattaagcagtaagccggtcataaaaccggtggttgtaaaagaattcggtggagcggtagttcagtcggttagaatacctgcctgtcacgcagggggtcgcgggttcgagtcccgtccgttccgccaccctaattaggggcgtagttcaattggtagagcaccggtctccaaaaccgggtgttgggagttcgagtctctccgcccctgccagaaatcatccttagcgaaagctaaggattttttttatctgaaataaccctctccgaagtaaatccttctaccggcatccttgccagccattcatattaatacacttcatccagcacgttaatttttaaaagatcgcgaatcaacgcatttttatcgctattttgcagccatatggcataaagcggccgtgaaagtgttgtgctatcgacaacggtatgcaggccgccttttttacgcgcccagctgacgggtagccaggtgcaaccattaagcatcgcaatctgttgctgtgccagttcagcagaactggttgtcagaatgggcacttcgtcagcaccgatcaaacctgcctcatgctgttgaaaatctggcccccactcaagtcgcagataattaagatctccctttagttttgaaggggcactggtataaagcgctaaagtgaaatatcccagcaactgactactaaattcgtccattttgggcgcttcagtggtaataagaagatcaagctggcgttcatgcagctgttttaccagagactgccgttgggcaattcgcgcttcgaactgtaagcctgtatgggcatcctgattttgatacaaacgtcccagccactgattaagcatacattcccacaatgaggcgctggcaccgatagaaaactcgttatgtcgtgaggtatgcgccacctccttgcgggcggcctgccaggtgctcatgagcgtttctgcataaggcagtagtttttcaccggcagcggttaaacggatattgtttctgtggcgggtgaaaaggttcacacccagttgattttccagttgtctgattcgaaagctcactgctgactgggtcagatagagcgattcagccgctcgaccaaagtgacgcgttcggctaacttccaggaaagtttttaacaattccgtatccacagtgctctccgcaaaattatttgtcgttatgatttaaatgttttgttttacactctgtcaagcgtaactaatactccgcgccataactagctcggtcaaagaattaggagcgtgcaggatggcggaaagctttacgacgactaatcgatatttcgacaataaacattatccacgtggattctctcgtcatggtgatttcaccatcaaagaggcacaactgcttgagcgtcatggttatgccttcaatgagttggatcttggcaaacgcgagccggttaccgaggaagagaaactcttcgtagcagtatgccgtggcgaacgtgagccagtgacagaagcagaacgcgtgtggtccaagtatatgacgcgtattaagcgtccaaaacgttttcacaccctttccggcggtaaaccgcaggttgaaggtgctgaagactacaccgattctgacgattaataaaaagggcgaaatgccctttttttatgtcagtagtttctgcagatggatgagcaaacggtcaatcgctcgatagctaactgcctcctgcaaatgttgacgtgtgataatgtcagactgatcaatatcagcaatggttcgtgcaactttcaataaccgctgccaggcacgaatcgataaccccagatggatcagcgtttcttccagccacatcgcatcttcgctctcaagtttgcagaattggcgtatttccggactatccagccaggcgttcagtttattctgccgcttaaattggcgctctctggcggccattacgcgttgtttaacggtggcgctgctttctcccggcactaccgttttactcaaaataccgggaggcggtaatgggatctccagtgagagatcgaagcggtcgagaaagggaccagagagtcggttgagataacgcagcgtttgctctggtgtgcagcggttatggtttccctgataatgtccggtagggctgggattcatcgccgcgacaagctggaaacgggctggataggttatttttgctcgcgtgcgtgaaagatggatctgcccggattcaatcggctctcgcaaggcatccagtgtacgcctttcaaattcaggtaactcatcaagaaaaagcacgccgttatgcgccagcgaaatttcaccgggccctggaattgcgccaccgcctaccatcgcagttaacgatgcactgtgatgaggtgagcggaacgggcgctgccgccattgtttttgtactgattcagcatttaccagacttaatatcgcagcactctccagtgcctcttcattgcttaaatctggcaacaggccattaatacggctggcgagcattgttttacctgttcccggaggcccaatcagtaaaaggttgtgcccgccagcggcggtaatttccagtcctcgctttccatgttcctgaccgacaacatcactgagatcatgttgtagcgcccgggatactgcatcagttggtttcgggcgttcgagagcgtgcttaccttccagaaacgcacagacagcttgcagatgatcggctatcaggcatccttcaccgttaattagccccacttcatcttcgttatctttcgcgacgataatttttctgcccgacttaatagcttcagttgcactggagattgcgccgggaacgccacgcagagcgcctgtaagcgccagttctccgactaattcatattcatctaacttattggctgtaagctgttctgaggccgccagcaacgcaatggcgataggtaaatcatatcgtcccccttcttttggtagatcggctggagcaaggttgatggtgatttttttcgccggatattcatatccgctattgataatggcgctgcgcacgcgatcgcgagcttctttcaccgttgtttctggtaagcccaccatcgttaagccgggtagacctttactgatatgtacctcaacagtgattgggggcgcatttactcccagggctgcgcgggtatgaacaattgacagtgacataagccctccttgagtcaccattatgtgcataagatatcgctgctgtagcccgctaattcgtgaattttagtggctgattcctgtttatttgtgcaagtgaagttgagttgttctggcggtggaatgatgctcgcaaaaatacagcggacaaaggatgaactaagaggaagggaacaacattcagaccgaaattgaatttttttcactcactattttctttttaaaaaacaacaatttctattgaaattattaaacgcatcataaaaatcggccaaaaaatatcttgtactatttacaaaacctatggtaactctttaagcattccttcgaacaagatgcaagaaaagacaaaatgacagcccttctacgagtgattagcctggtcgtgattagcgtggtggtgattattatcccaccgtgcggggctgcacttggacgaggaaaggcttagaaatcaagccttaacgaactaagacccccgcaccgaaaggtccgggggttttttttgaccttaaaaacataaccgaggagcagacaatgaataacagcacaaaattctgtttctcaagattcaggacggggaactaactatgaatggcgcacagtgggtggtacatgcgttgcgggcacagggtgtgaataccgttttcggttatccgggtggcgcaattatgccggtttacgatgcattgtatgacggcggcgtggagcacttgctgtgccgacatgaacagggtgcggcaatggcggctatcggttatgcccgtgctactggcaaaactggcgtatgtatcgccacgtctggtccgggcgcaaccaacctgataaccgggcttgcggacgcactgttagattccatccccgttgttgccatcaccggtcaagtgtccgcaccgtttatcggcacggacgcatttcaggaagtggatgtcctgggattgtcgctagcctgtaccaagcacagcttcctggtgcagtcgctggaagagttgccgcgcatcatggctgaagcattcgacgttgccagctcaggtcgtcctggtccggttctggtcgatatcccaaaagatatccaattagccagcggcgacctggaaccgtggttcaccaccgttgaaaacgaagtgactttcccacatgccgaagtcgagcaagcgcgccagatgctggcaaaagcgcaaaaaccgatgctgtacgttggtggtggcgtgggtatggcgcaggcagttcctgctttacgagaatttctcgctaccacaaaaatgcctgccacctgcacgctgaaagggctgggcgcagttgaagcagattatccgtactatctgggcatgctgggaatgcatggcaccaaagcggcgaacttcgcggtgcaggagtgcgacttgctgatcgccgtgggtgcacgttttgatgaccgggtgaccggcaaactgaacaccttcgcaccacacgccagtgttatccatatggatatcgacccggcagaaatgaacaagctgcgtcaggcacatgtggcattacaaggtgatttaaatgctctgttaccagcattacagcagccgttaaatatcaatgactggcagcaacactgcgcgcagctgcgtgatgaacatgcctggcgttacgaccatcccggtgacgctatctacgcgccgttgttgttaaaacaactgtcggatcgtaaacctgcggattgcgtcgtgaccacagatgtggggcagcaccagatgtgggctgcgcagcacatcgcccacactcgcccggaaaatttcatcacctccagcggcttaggtaccatgggttttggtttaccggcggcggttggcgcacaagtcgcgcgaccgaacgataccgttgtctgtatctccggtgacggctctttcatgatgaatgtgcaagagctgggcaccgtaaaacgcaagcagttaccgttgaaaatcgtcttactcgataaccaacggttagggatggttcgacaatggcagcaactgttttttcaggaacgatacagcgaaaccacccttactgataaccccgatttcctcatgttagccagcgccttcggcatccctggccaacacatcacccgtaaagaccaggttgaagcggcactcaacaccatgctgaacagtgatgggccatacctgcttcatgtctcaatcgacgaacttgagaacgtctggccgctggtgccgccaggtgccagtaattcagaaatgttggagaaattatcatgatgcaacatcaggtcaatgtatcggctcgcttcaatccagaaaccttagaacgtgttttacgcgtggtgcgtcatcgtggtttccacgtctgctcaatgaatatggccgccgccagcgatgcacaaaatataaatatcgaattgaccgttgccagcccacggtcggtcgacttactgtttagtcagttaaataaactggtggacgtcgcacacgttgccatctgccagagcacaaccacatcacaacaaatccgcgcctgagcgcaaaaggaatataaaaatgaccacgaagaaagctgattacatttggttcaatggggagatggttcgctgggaagacgcgaaggtgcatgtgatgtcgcacgcgctgcactatggcacctcggtttttgaaggcatccgttgctacgactcgcacaaaggaccggttgtattccgccatcgtgagcatatgcagcgtctgcatgactccgccaaaatctatcgctttccggtttcgcagagcattgatgagctgatggaagcttgtcgtgacgtgatccgcaaaaacaatctcaccagcgcctatatccgtccgctgatcttcgtcggtgatgttggcatgggcgttaacccgccagcgggatactcaaccgatgtgattatcgccgctttcccgtggggagcgtatctgggcgcagaagcgctggagcaggggatcgatgcgatggtttcctcctggaaccgcgcagcaccaaacaccatcccaaccgcggcaaaagccggtggtaactacctctcttccctgctggtgggtagtgaagcacgccgccacggttatcaggaaggtatcgcgctggatgtgaatggttacatctctgaaggtgcaggcgaaaacctgtttgaagtgaaagacggcgtgctgttcaccccaccgttcacctcctccgcgctgccgggtattacccgtgatgccatcatcaaactggcaaaagagctgggaattgaagtccgtgagcaggtgctgtcgcgcgaatccctgtacctggcggatgaagtgtttatgtccggtactgcggcagaaatcacgccagtgcgcagcgtagatggtattcaggttggtgaaggccgttgcggcccggttaccaaacgcatccagcaagccttcttcggcctcttcactggcgaaaccgaagataaatggggctggttagatcaagttaatcaataaatacaaaaaatgggacggcacgcaccgtcccatttacgagacagacactgggagtaaataaagcatgcctaagtatcgttccgctaccaccacccatggccgtaatatggcgggggcccgcgcactgtggcgcgccaccgggatgaccgacgccgatttcggtaagccgattatcgcggttgtgaactcgttcacccaatttgtaccgggtcacgtccatctgcgcgatctcggtaaactggtcgccgaacaaattgaagcggctggcggcgttgccaaagagttcaacaccattgcggtggatgatgggattgccatgggccacggggggatgctttattcactgccatctcgcgaactgatcgctgattccgttgagtatatggtcaacgcccactgcgccgatgccatggtctgtatctccaactgcgacaaaatcacccctgggatgttgatggcttccctgcgattaaatattccggtgatctttgtttccggcggcccgatggaagccgggaaaaccaagctgtccgatcggataatcaagctcgatctggttgatgcgatgatccagggcgcagacccgaaagtctctgactcccagagcgatcaggttgaacgttccgcctgcccaacctgcggttcctgctccgggatgtttaccgctaactcaatgaactgcctgaccgaagcgctgggtttgtcgcagccaggcaacggctcgctgctggcaacccacgcggaccgtaagcagctgttccttaatgctggtaaacgcattgttgaattgaccaaacgttattacgagcaaaacgacgaaagtgcactgccgcgtaatatcgccagtaaggcggcgtttgaaaacgccatgacgctggatatcgcgatgggtggatcgactaacaccgtacttcacctgctggcggcggcgcaggaagcggaaatcgacttcaccatgagtgatatcgataagctctcccgcaaggttccgcagctgtgtaaagttgcgccgagcacccagaaataccatatggaagatgttcatcgtgctggtggtgttatcggtattctcggcgaactggatcgtgcggggttactgaaccgtgatgtgaaaaacgtacttggcctgacgttgccgcaaacgctggaacaatacgacgttatgctgacccaggatgacgcggtaaaaaatatgttccgcgcaggcccggcgggcattcggactacacaggcattctcgcaggattgccgttgggattctctcgatgacgatcgcgcaaacggctgtatccgctcgctggaacacgcctacagcaaagacggcggcctggcggtgctctacggtaatttcgcagaaaacggctgcatcgttaaaaccgcgggcgtcgatgacagcatcctcaaattcaccggcccggcgaaagtgtacgaaagccaggacgacgcggtagaagcgattctcggcggtaaagttgtcgccggagatgtggtagtaattcgctatgaaggcccgaaaggcggtccggggatgcaggaaatgctctacccaaccagcttcctgaaatcaatggggctcggtaaagcctgtgcgctgatcaccgacggtcgtttctctggcggcacctctggcctttctatcgggcacgtctcaccggaagcggcaagcggcggcagcattggcctgattgaagacggcgatcttatcgctatcgacattccgaaccgtggtattcagttacaggtaagcgatgccgaactggcggcgcgtcgtgaagcgcaggaagcccggggtgacaaagcctggacgccgaaaaaccgtgaacgtcaggtttcctttgcgctgcgtgcctacgccagcctggcgaccagcgccgacaaaggtgcggtgcgcgataaatcgaaactggggggttaatgatggctgactcgcaacccctgtccggcaccccggaaggtgccgaatatttaagagcggtgctacgcgcgccggtctatgaagcggcgcaggttacgccgctacagaaaatggaaaaactgtcgtcgcgtcttgataacgtgattctggtgaagcgcgaagatcgccagccggtgcacagctttaagctgcgcggtgcatacgccatgatggcgggcctgacggaagaacaaaaagcgcacggcgtgatcaccgcttctgcgggtaaccacgcgcagggcgtcgcgttttcttccgcacggttaggcgtgaaggcactgatcgtcatgccaaccgccaccgccgatatcaaagttgatgcggtgcgcggcttcggcggcgaagtgctgctccacggtgcgaactttgatgaagcgaaagccaaagcgatcgaactgtcacagcagcaggggttcacctgggtgccgccgttcgaccatccgatggtgattgccgggcaaggcacgctggcgctggaactgctccagcaggacgcccatctcgaccgcgtatttgtgccagtcggcggcggcggtctggctgctggcgtggcggtgctgatcaaacaactgatgccgcaaatcaaagtgatcgccgtagaagcggaagactccgcctgcctgaaagcagcgctggatgcgggtcatccggttgatctgccgcgcgtagggctatttgctgaaggcgtagcggtaaaacgcatcggtgacgaaaccttccgtttatgccaggagtatctcgacgacatcatcaccgtcgatagcgatgcgatctgtgcggcgatgaaggatttattcgaagatgtgcgcgcggtggcggaaccctctggcgcgctggcgctggcgggaatgaaaaaatatatcgccctgcacaacattcgcggcgaacggctggcgcatattctttccggtgccaacgtgaacttccacggcctgcgctacgtctcagaacgctgcgaactgggcgaacagcgtgaagcgttgttggcggtgaccattccggaagaaaaaggcagcttcctcaaattctgccaactgcttggcgggcgttcggtcaccgagttcaactaccgttttgccgatgccaaaaacgcctgcatctttgtcggtgtgcgcctgagccgcggcctcgaagagcgcaaagaaattttgcagatgctcaacgacggcggctacagcgtggttgatctctccgacgacgaaatggcgaagctacacgtgcgctatatggtcggcggacgtccatcgcatccgttgcaggaacgcctctacagcttcgaattcccggaatcaccgggcgcgctgctgcgcttcctcaacacgctgggtacgtactggaacatttctttgttccactatcgcagccatggcaccgactacgggcgcgtactggcggcgttcgaacttggcgaccatgaaccggatttcgaaacccggctgaatgagctgggctacgattgccacgacgaaaccaataacccggcgttcaggttctttttggcgggttagggaaaaatgcctgatagcgcttcgcttatcaggcctacccgcgcgacaacgtcatttgtggttcggcaaaatcttccagaatgcctcaattagcggctcatgtagccgctttttctgcgcacacacgcccagctcaaacggcgttttctcatcgctgcgctctaaaatcatcacgcggttacgcaccggttcggggctgttttccagcaccacttccggcaacaatgccacgccacagccgagtgccaccatcgataccatcgcttcatgcccgccaaccgtggcgtaaatcatcgggttactgattttattgcgtcgaaaccacagttcaatgcggcggcgtaccggcccctgatcggccataataaacggcaccgttgaccagtccggcttctctaccgacacctgattacgcaccgggcagggcagcgcgggggcaatcagcactactgccagattctccaacatcgaaaacgccactgcgccgggcaaggtttccggtttacccgcaatcgccagatccgcttcaccagtgaccaccttttccatcgcatctgccgcatcaccagtagtaagtttaatctccaccgacgggtgttccgcgcggaagcgatccagaatcggcggcagatggctgtaggcagcggtcaccgagcagaagatatgtaattcgccagagagcgacggcccttgctgatcgatggtgtggcgcaactgctgatactgcaacagcgtttgctgggcgaaaacgcgcagctcttcgcccgcttcagtcagcgtcaccgtgcggttatcgcgcacaaacagcggctgaccgagatcttcttccaggcgctgaatctgccgtgagagcgtggatgggctaacgtgcatcgcccgcgcgctgcggccaaaatggcggctttccgccagatgcaggaaggttttcagatcgcgtaaatccacagggacagccctcgatgttgacgttgcaaaaattgcaatgtgacgttgtgaatatatcaatttccgcaataaatttcctgtcatatagtgaattcaatctcgcaaacgcgaaccgaacaataagaagcacaacatcacgaggaatcaccatggctaactacttcaatacactgaatctgcgccagcagctggcacagctgggcaaatgtcgctttatgggccgcgatgaattcgccgatggcgcgagctaccttcagggtaaaaaagtagtcatcgtcggctgtggcgcacagggtctgaaccagggcctgaacatgcgtgattctggtctcgatatctcctacgctctgcgtaaagaagcgattgccgagaagcgcgcgtcctggcgtaaagcgaccgaaaatggttttaaagtgggtacttacgaagaactgatcccacaggcggatctggtgattaacctgacgccggacaagcagcactctgatgtagtgcgcaccgtacagccactgatgaaagacggcgcggcgctgggctactcgcacggtttcaacatcgtcgaagtgggcgagcagatccgtaaagatatcaccgtagtgatggttgcgccgaaatgcccaggcaccgaagtgcgtgaagagtacaaacgtgggttcggcgtaccgacgctgattgccgttcacccggaaaacgatccgaaaggcgaaggcatggcgattgccaaagcctgggcggctgcaaccggtggtcaccgtgcgggtgtgctggaatcgtccttcgttgcggaagtgaaatctgacctgatgggcgagcaaaccatcctgtgcggtatgttgcaggctggctctctgctgtgcttcgacaagctggtggaagaaggtaccgatccagcatacgcagaaaaactgattcagttcggttgggaaaccatcaccgaagcactgaaacagggcggcatcaccctgatgatggaccgtctctctaacccggcgaaactgcgtgcttatgcgctttctgaacagctgaaagagatcatggcacccctgttccagaaacatatggacgacatcatctccggcgaattctcttccggtatgatggcggactgggccaacgatgataagaaactgctgacctggcgtgaagagaccggcaaaaccgcgtttgaaaccgcgccgcagtatgaaggcaaaatcggcgagcaggagtacttcgataaaggcgtactgatgatcgcgatggtgaaagcgggcgttgaactggcgttcgaaaccatggtcgattccggcatcattgaagagtctgcatattatgaatcactgcacgagctgccgctgattgccaacaccatcgcccgtaagcgtctgtacgaaatgaacgtggttatctctgataccgctgagtacggtaactatctgttctcttacgcttgtgtgccgttgctgaaaccgtttatggcagagctgcaaccgggcgacctgggtaaagctattccggaaggcgcggtagataacgggcaactgcgtgatgtgaacgaagcgattcgcagccatgcgattgagcaggtaggtaagaaactgcgcggctatatgacagatatgaaacgtattgctgttgcgggttaagtgcgcgctgatgccctcaccccgaccctctcccacagggagagggagaaaacactcaaggccttctcctggagaaggccttgctattagttgcggtacagcaccttaatgatgtgatatccgaactgggtgtgcagcgggccggtcggctccagtaccggacaagagaaaaccactttatcgaacgccggaaccatctgaccctggcggaattcacctaaatcaccgccgcgtttgcctgatgggcaaatggagtgtttcttcgccagcttgccgaaatcggccccgttcttaatctgctcgagaagatccagagccagtttctcttcttttacaaggatatgcagtgctgctgctgtttttgccatgatcgtgccttgagtgaataattgtcaggcggcgattttagcatgatccgcagatgctaacgtaattgtcagtcagggagtggctggtacatatatggcaaaagcccggaaaatccgggcttcgcaggtccctcaaggggagaaaacttagggcctctatgggctacaaagtcattatcggggatggttattttattgtcaatttatgagcgatatggcattgattgacttgatgaccgccctctgtatgtctgcaaccaactcatgtggcaaacattgattaagataccctctgtaagtccttgctctgtttaatctgtttcgactgacttgttgtaccaggtcggctttggcccaacgaatctgctgatcaaagaattgcaggtcattgataacattactggctatttcaacatgcattccacgttttaacttgtctggtcgcgagtggttgataatggaacgacgatgcatgcgttgccattaatttttccgttgagcacgacaactaacctgttttttatcatttcaggaggaatgcggccatcgtaatacgtcgtgctgaacggtccattttggctaacaggatagttaccaaagttgcattccagtatttcaccaaccttagggctgaaattaatcgccacgagtaaacctctccttagtaaactctgaaaaagtaataacacaacgttacgacccgatattttctaagtctaatggattcacgatgaactccgatttcggtcttctctctctgatttaaacatccgcagccaaccggttagcggcttacacgcggtcacattcaaatgcgattctgctacaatcctccccccgttcgaagattgagcaatacacctatgcgtctaaaccccggccaacaacaagctgtcgaattcgttaccggcccctgcctggtgctggcgggcgcgggttccggtaaaactcgtgttatcaccaataaaatcgcccatctgatccgcggttgcggttatcaggcgcggcacattgcggcggtgacctttactaataaagcagcgcgcgagatgaaagagcgtgtagggcagacgctggggcgcaaagaggcgcgtgggctgatgatctccactttccatacgttggggctggatatcatcaaacgcgagtatgcggcgcttgggatgaaagcgaacttctcgttgtttgacgataccgatcagcttgctttgcttaaagagttgaccgaggggctgattgaagatgacaaagttctcctgcaacaactgatttcgaccatctctaactggaagaatgatctcaaaacaccgtcccaggcggcagcaagtgcgattggcgagcgggaccgtatttttgcccattgttatgggctgtatgatgcacacctgaaagcctgtaacgttctcgacttcgatgatctgattttattgccgacgttgctgctgcaacgcaatgaagaagtccgcgagcgctggcagaacaaaattcgctatctgctggtggatgagtatcaggacaccaacaccagccagtatgagctggtgaaactgctggtgggcagccgcgcgcgctttaccgtggtgggtgacgatgaccagtcgatctactcctggcgcggtgcacgtccgcaaaacctggtgctgctgagtcaggattttccggcgctgaaggtgattaagcttgagcagaactatcgctcttccgggcgtattctgaaagcggcgaacatcctgatcgccaataacccgcacgtctttgaaaagcgtctgttctccgaactgggttatggcgcggagctaaaagtattaagcgcgaataacgaagaacatgaggctgagcgcgttactggcgagctgatcgcccatcacttcgtcaataaaacgcagtacaaagattacgccattctttatcgcggtaaccatcagtcgcgggtgtttgaaaaattcctgatgcaaaaccgcatcccgtacaaaatatctggtggtacgtcgtttttctctcgtcctgaaatcaaggacttgctggcttatctgcgcgtgctgactaacccggacgatgacagcgcatttctgcgtatcgttaacacgccgaagcgagagattggcccggctacgctgaaaaagctgggtgagtgggcgatgacgcgcaataaaagcatgtttaccgccagctttgatatgggcctgagtcagacgcttagcggacgtggttatgaagcattgacccgcttcactcactggttggcagaaatccagcgtctggcggagcgggagccgattgccgcggtgcgtgatctgatccatggcatggattatgaatcctggctgtacgaaacatcgcccagcccgaaagccgccgaaatgcgcatgaagaacgtcaaccaactgtttagctggatgacggagatgctggaaggcagtgaactggatgagccgatgacgctcacccaggtggtgacgcgctttactttgcgcgacatgatggagcgtggtgagagtgaagaagagctggatcaggtgcaactgatgactctccacgcgtcgaaagggctggagtttccttatgtctacatggtcggtatggaagaagggtttttgccgcaccagagcagcatcgatgaagataatatcgatgaggagcggcggctggcctatgtcggcattacccgcgcccagaaggaattgacctttacgctgtgtaaagaacgccgtcagtacggcgaactggtgcgcccggagccgagccgctttttgctggagctgccgcaggatgatctgatttgggaacaggagcgcaaagtggtcagcgccgaagaacggatgcagaaagggcaaagccatctggcgaatctgaaagcgatgatggcggcaaaacgagggaaataatcaaggccggaaaagatgcgtcagcatcgcatccggcacttactcattaatgcacttccagcggccagtggacatagctctgccactggctttcctgagcaataatctctttacccagcggatgttgggttagccaaccttgcggaagcgtcaaggtcaacagttcatggttagcctgtaatgtcatctctggcacgagatcgtcacggcgacggctggcaaaaatgatggccaggcgtagtaaacggcagagttgttctgcgacgcgcggcggtacggcattttgctgatgcagcgatgagagatcgaccggattagtctggttgagcagtagcgtcgccagcaattttttctgtgcgggggtaaaaccgggaagatccagattacgcaccagataagcagcgtgttgcggcgcttgtttgaagtcaacgctcaggccgatttcatgaagctgacaggcgctgatgagcaaatcgcggcttattgcttcaagatgccattcgttttccacctgatcgaagaagttagccgcaactttggctacgcgctgtgcctgatcaatatcgatcataaagcggcgttgaatattacgcagcgtacggctgcgaatatcctgctcgacggccagatgcaacatgccgtagaccaggccttcacgcagcgcaccgcccgccagggtcatacactgaatattcagttcggtaaaaatggcgatcaggatcgccagaccactcgggaacactaacgcacgttccagcgtcagcccgtcaatctccagttcctccagccgaccgcaatgaatggctcgctgtttcaattgctgcaacttttccagggtaatgcgttcatccatcccctgtgccatcatgatttcctgtaacgcctgcacggtgccggaagcaccaacgcacactttccagccgtgataccgtaattcatcggcaaccggacgtaacacttcgcgtgccgctttttctgcagcatcaaaattttcctgccccagattacgatcggcaaaatagcgttccagccaagtgacgcagcccatcgacaggctgaacaacgaggtggtttgtgcacccgtgccggttaccagttcagtactggctccgcctatatccaccaccaggcgctgatcggcaccaccagtggtgtgagcaacgccctgataaatcagacgtgcttcctcttcaccgctgatcacctgtaccggacaaccgagaatttcctgcgctttggcaataaaatcacccgcattgacggcaaggcgtaacgtcgccgtagcgacaacgcgaatttgcgagggaggaatatcttgcagacgttcagcaaacaggcgcaaacattgccaaccgcgctccattgcttcattggagagggcattttcgctattcaggccagcagccagacgcactttgcgttttattcgcgtcagcgtctggatgcttccagccacctcgcgcacaaccagcatatgaaaactattcgaaccgagatcaatggctgcatacagcgacgaggtggaacccatactcttcatccttcaatctgtctctgtgttggctgcattctttcacctgaatcacttactacagtaagctcatcgggattcattctcttgccatcttgatacagtttgaatgattttgagtatgacattttttatttaacctgaacgacgacgattacgcggagcgccagtacgacgcggaccattgcctgtgcgcgggcgcgtgaggcgcagcggttttggcagatcggtcatcaatgcgtccggattgtatttgcttaccggaattgagtgaccaatataggtctcaatagcaggcaaattcaatgcatactcttcacacgccaggctgatagagtgaccgcttgcgcctgcgcgacctgtacgaccaatacggtgaacgtaatcttcacagtcatcgggtaaatcgtagttaaagacgtgcgtcactgccggaatatgcaaaccacgcgcggcaacgtcggtggcaaccagaatatccagatcgccacgggtaaattcatcaagaatacgcagacgttttttctgcgcgacatcgcctgtcaacaaaccgacacgatgaccatctgccgccaggtggccccagatctcttcacaacggtgtttggtattggcgaaaataatcgctctgtctggccactcttcttcgatcagcgtttgcagcaaacgcattttttcttcgttagaagggtagaaaagctcttctttaatacggtggcccgttttctgttccggttccacttcaatatattcggcattgttcatctgctcgaacgccagttcacgtacccggtacgaaagcgtggcggagaacagcatgttgaggcgctggtttgcaggcggcatacggcggaacagccagcggatatctttaataaagcccagatcgtacatgcgatcggcttcgtccagtaccactacctgaatggcaccgaggttaatatggttctgcttggcatagtcaattaaacgacccgtggtgccaatcagaatgtcaacgccgctttccagcactttcagctgtttgtcgtagccatcaccaccgtaagccagacccagcttcaggccagtagcttccgccagcggttctgcgtcggcatggatctgcacggcaagttcacgcgtcggtgccataattaaggcacgcggttgattcaccttgcgatcggcaatcgcaggatgagagagaagataatgaaacgttgacgtaagaaacgccatcgttttcccggtaccggtttgcgcctgcccggctacgtcacgacccgccagcgtcagcggaagggccagtgcctgaatgggcgtacagttatgaaacccttttttttcaagggcttctacaaccttcggatgcagggcgaagtcggaaaacttctgttctgttaaatgtgttttgctcatagtgtggtagaatatcagcttactattgctttacgaaagcgtatccggtgaaataaagtcaacctttagttggttaatgttacaccaacaacgaaaccaacacgccaggcttattcctgtggagttatatatgagcgataaaattattcacctgactgacgacagttttgacacggatgtactcaaagcggacggggcgatcctcgtcgatttctgggcagagtggtgcggtccgtgcaaaatgatcgccccgattctggatgaaatcgctgacgaatatcagggcaaactgaccgttgcaaaactgaacatcgatcaaaaccctggcactgcgccgaaatatggcatccgtggtatcccgactctgctgctgttcaaaaacggtgaagtggcggcaaccaaagtgggtgcactgtctaaaggtcagttgaaagagttcctcgacgctaacctggcgtaagggaatttcatgttcgggtgccccgtcgctaaaaactggacgcccggcgtgagtcatgctaacttagtgttgacttcgtattaaacataccttattaagtttgaatcttgtaatttccaacgcttcccgttttatcttaaatgcgaagtgaacagatttctggctcgtcactcaatccgtcttgtcgtttcagttctgcgtactctcctgtgaccaggcagcgaaaagacatgagtcgatgaccgtaaacaggcatggatgatcctgccataccattcacaacattaagttcgagatttaccccaagtttaagaactcacaccactatgaatcttaccgaattaaagaatacgccggtttctgagctgatcactctcggcgaaaatatggggctggaaaacctggctcgtatgcgtaagcaggacattatttttgccatcctgaagcagcacgcaaagagtggcgaagatatctttggtgatggcgtactggagatattgcaggatggatttggtttcctccgttccgcagacagctcctacctcgccggtcctgatgacatctacgtttcccctagccaaatccgccgtttcaacctccgcactggtgataccatctctggtaagattcgcccgccgaaagaaggtgaacgctattttgcgctgctgaaagttaacgaagttaacttcgacaaacctgaaaacgcccgcaacaaaatcctctttgagaacttaaccccgctgcacgcaaactctcgtctgcgtatggaacgtggtaacggttctacggaagatttaaccgctcgcgtactggatctggcatcacctatcggtcgtggtcagcgtggtctgattgtggcaccgccgaaagccggtaaaactatgctgctgcagaacattgctcagagcattgcttacaaccacccggattgtgtgctgatggttctgctgatcgacgaacgtccggaagaagtaaccgagatgcagcgtctggtaaaaggtgaagttgttgcttctacctttgacgaacccgcatctcgccacgttcaggttgcggaaatggtgatcgagaaggccaaacgcctggttgagcacaagaaagacgttatcattctgctcgactccatcactcgtctggcgcgcgcttacaacactgttgttccggcgtcaggtaaagtgttgaccggtggtgtggacgccaatgcccttcatcgtccgaaacgcttcttcggtgcggcgcgtaacgtggaagagggcggcagcctgaccattatcgcgacggcgcttatcgataccggttctaaaatggacgaagttatttacgaagagtttaaaggtacaggcaacatggaactgcacctctctcgtaagatcgctgaaaaacgcgtcttcccggctatcgactacaaccgttccggtacccgtaaagaagagctgctcacgactcaggaagaactgcagaaaatgtggatcctgcgcaaaatcattcacccgatgggcgaaatcgatgcaatggaattcctcattaataaactggccatgaccaagaccaatgacgatttcttcgaaatgatgaaacgctcataaatttgtcttatgccaaaaacgccacgtgtttacgtggcgttttgcttttatatctgtaatcttaatgccgcgctggcgatgttaggaaaattcctggaatttgctggcgtgttatgcaatttgcatatcaaatggttaatttttgcacaggactggtgggttcggaacggactttcccttctgaataaaggtcttcgtggttatacttctgctaataattttctctgagagcatgcattgtgaatttactgacagtgagtattgatctcatcagtatttttttattcacgacactgtttctgttttttgcccgtaaggtggcaaaaaaagtcggtttagtggataaaccaaacttccgcaaacgtcaccagggattgatacctctcgttggggggatttcggtttacgcagggatttgcttcacgttcggaattgtcgattactatattccgcatgtatctctctatctcgcttgtgccggtgtgcttgttttcattggcgcgctggatgaccgttttgatatcagcgtaaaaatccgtgccaccatacaggccgctgttggcattgttatgatggtgttcggcaagctttatctcagtagcctgggttatatctttggctcctgggagatggtgctcggaccgtttggttacttcctgacgctatttgccgtctgggcggccattaatgcgttcaacatggttgatggcattgatggcttgctgggcgggttgtcctgcgtctcgtttgcagcaatcggtatgattttgtggttcgacgggcaaaccagcctcgcaatctggtgctttgcgatgatcgccgccatcctgccatacatcatgcttaaccttggtatcctgggtcgccgctacaaagtctttatgggtgatgcgggcagtacgctgattggttttaccgttatctggatcctgctcgaaacgacccagggcaaaacccatcccatcagcccggttaccgctttgtggataatcgccattccgctaatggatatggtggcgattatgtaccgtcgcctgcgtaaaggcatgagcccattctctcctgaccgtcagcatattcaccatttgatcatgcgtgccgggtttacttcccgtcaggcgtttgtgctgattacccttgccgcagcactgctcgcttccattggcgtgctggcagaatattctcattttgtcccggagtgggtcatgctggtgctctttttgctagcattcttcctctatggatattgcattaagcgtgcctggaaagttgctcgctttattaagcgcgtaaaacgcagactgcgtagaaatcgtggtggcagccccaatttaaccaaataaatgaggatgtgatgacacaaccaatgcctgggaaaccggccgaagacgctgaaaatgaactggatattcgtgggttgtttcgtaccttgtgggctgggaagctatggattattggcatggggctggcgtttgcgttaatcgcgctggcgtatacgttttttgctcgtcaggagtggagctcgacggcgattaccgatcgtccaacggtgaatatgctggggggatattactcgcagcagcaatttttgcgtaacctggatgtccgttcaaacatggcttctgccgaccaaccatcggtcatggacgaagcctataaagagtttgttatgcaactggcctcgtgggatacccgcagagagttctggctgcaaaccgactattacaaacagcggatggtgggcaacagcaaagccgatgcggcgttgctggatgaaatgattaacaacatccagtttatccccggagactttacccgcgcggtcaatgacagcgtgaagcttattgccgaaaccgcgcctgacgctaataacctgttacgtcagtatgttgcttttgccagccagcgtgcagccagccatctgaatgatgagctgaaaggcgcatgggcggcgcgtaccatccagatgaaagctcaggtgaagcgtcaggaagaggtggcgaaagccatctacgaccgccggatgaacagcattgagcaggcgctgaaaattgctgagcagcataatatttcgcgcagtgcgacagatgtacctgccgaggaattacctgattcagaaatgttcctgcttgggcgtccaatgcttcaggctcgactggaaaatttacaggccgtcggtccggcctttgatctcgactatgatcagaatcgggccatgttaaacaccctgaatgttggtccaaccctggatccgcgttttcagacctatcgctatttgcgtacgccggaagaaccggtaaaacgcgatagcccacgtcgtgccttcctgatgattatgtggggcattgtcggggggctgatcggggctggtgtcgcattaacccgccgttgctcgaaatagcaacactgctgcggtgagcgcaaaggcgctcgccgcttattcgaagagaatcgatgtgaaagtactgactgtatttggtacgcgcccggaagccatcaagatggcgccgttggtgcatgcgttggcaaaagatcctttttttgaggctaaagtttgcgtcactgcgcagcatcgggagatgctcgatcaggtgctgaaactcttttccattgtacctgactacgatctcaacataatgcagccaggacagggcctgacagagataacctgtcggattctggaagggctaaaacctattcttgccgagttcaaaccagacgtcgtgctggttcacggcgatacgacgacgacgctggcaaccagcctggcggcgttttatcagcgtattcctgttggtcacgttgaggctggtctgcgcacgggcgatctctattcgccgtggccggaagaggctaaccgtacattgaccgggcatctggcgatgtatcacttctctccaaccgaaacttcccggcaaaacttgctgcgtgaaaacgttgcggatagccgaatcttcattaccggtaatacagtcattgatgcactgttatgggtgcgtgaccaggtgatgagcagcgacacgctgcgttcagaactggcggcaaattacccgtttatcgaccccgataaaaagatgattctggtgaccggtcacaggcgtgagagtttcggtcgtggctttgaagaaatctgccacgcgctggcagacatcgccaccacgcaccaggacatccagattgtctatccggtgcatctcaacccgaacgtcagagagccggtcaatcgcattctggggcatgtgaaaaatgtcattctgatcgatccccaggagtatttaccgtttgtctggctgatgaaccacgcctggctgattttgaccgactcaggcggcattcaggaagaagcgccttcgctggggaaacctgtgctggtgatgcgcgataccactgagcgtccggaagcggtgacggcgggtacggtgcgtctggtaggcacggataagcagcgaattgtcgaggaagtgacgcgtcttttaaaagacgaaaacgaatatcaagctatgagccgcgcccataacccgtatggtgatggtcaggcatgctctcgcattctggaagcgttaaaaaataatcggatatcactatgagttttgcgaccatttctgttatcggactgggttatatcgggctgccaacggcagcagcgtttgcctcacggcaaaaacaggtaattggtgtcgatatcaaccaacatgcggttgataccatcaatcgtggcgaaatccatatcgtcgaacctgatttggcgagtgtagtaaaaactgccgtagaaggcggttttttacgagcgagcacgacgccagttgaagcggatgcctggctgattgctgtacccacgccgtttaagggcgatcatgagccagatatgacctacgttgaatcggctgctcgctccattgcgccagtgctgaaaaaaggcgcgctggtgatccttgaatccacctcgccggtggggtcaaccgagaagatggcagaatggttagcagagatgcgtccggatctcactttcccgcagcaggtgggcgagcaggcggacgtcaacattgcttactgcccggaacgcgtgttaccaggacaggtaatggtcgagctgattaaaaacgatcgcgtgattggtggtatgacgccggtttgttcggcccgcgccagcgaactgtacaaaattttcctcgaaggtgagtgtgtcgtcactaactcgcggacggcggaaatgtgtaagctcaccgaaaacagcttccgcgatgtgaatatcgcttttgctaatgaattgtcgctgatttgtgccgatcaggggattaacgtctgggaactgattcgcctggcgaatcgtcaccctcgcgttaatattcttcagcctggccctggcgtgggcggtcactgcattgctgttgatccgtggtttatcgtggcacagaacccccagcaggcgcggcttatccgtaccgcgcgcgaagttaacgatcacaaaccgttctgggttatcgatcaggtgaaagcggcggttgccgactgccttgctgctaccgataaacgcgccagtgaactgaaaatcgcctgctttggtctggcgtttaaaccgaatattgatgacctgcgcgaaagcccggcgatggaaatcgctgaactgatcgcccagtggcacagcggcgaaacgctggttgttgagcctaacatccaccagttgccgaaaaaactgaccgggctttgtactctggcgcagcttgacgaggcgctggcaacggcagacgtgctggtgatgctggtcgatcatagtcagttcaaagttatcaatggcgacaatgtccatcagcagtatgtcgtcgatgccaaaggagtctggcgctgatgagaaaaattctgataacaggtggtgccgggtttattggctcggcgctggtgcgttatatcatcaacgaaacgagcgatgcggtggtagtggtcgataagctgacctacgccggaaacctgatgtcgctggcaccggtcgcgcaaagcgagcactttgcctttgagaaagttgatatctgcgatcgggcagaactggcacgcgtattcactgagcatcagccagactgtgtcatgcatctggcagccgaaagccatgttgaccgttctattgacggcccggcagcgtttattgaaaccaacattgtcgggacttatacattgcttgaagcggcgcgggcttactggaatacgctgacggaagataaaaaatcagcgttccgttttcatcatatctccaccgacgaagtatatggtgacctgcactcgacggatgatttcttcaccgaaaccacgccgtatgcgccgagcagcccttattccgcgtcaaaagccagcagcgaccatctggtgcgcgcctggctgcggacctacggtctgccgacgctgatcaccaactgctcgaataactacggtccttaccactttccggaaaaactgatcccgctgatgatcctcaacgcgctggcgggtaaaccgctgccggtatatggcaacgggcagcaaatccgtgactggctgtatgtggaagatcacgcccgcgcgctgtattgcgtggcgaccaccgggaaagtcggtgaaacctataatattggtggtcacaacgagcgtaagaatctcgatgttgtggaaaccatttgcgagctgctggaagaactggctccgaacaagccgcacggcgtggtgcactatcgtgacttgatcacctttgtcgctgaccgtccggggcatgatctgcgttatgccattgatgcttcgaaaattgcccgtgaacttggttggctgccacaggaaacctttgaaagtggaatgcgtaaaacggtgcagtggtatctggctaatgaaagctggtggaagcaggtgcaggacggcagctatcagggcgagcgtttaggtctgaaaggctaattttcagcggaggcaaacatgaaaggtattatcctggcgggcggttccggcacccgattgcatccgattacgcgcggcgtatcgaagcaactgttgccgatttacgataagccaatgatttactatccgctgtcggtgctgatgctggccggtatccgcgaaattctcatcatcactacgccggaagataaaggttatttccagcgcctgctgggcgatggtagtgagttcggtatccagctggaatatgccgaacagcccagcccggacggtctggcgcaggcctttatcatcggtgaaaccttccttaatggtgaaccttcttgtctggtgctgggcgataacatcttcttcggtcagggcttcagtccgaagctgcgtcatgttgcggcgcgcacggaaggggcgacggtttttggctatcaggtgatggacccggaacgctttggcgtggtggaatttgacgacaatttccgcgctatctcgctggaagaaaagccaaaacagccgaagtcaaactgggcggtgaccgggctttatttctacgacagtaaagtcgtggagtacgcaaagcaggtgaagccgtcggagcgcggtgaactggagattacctccatcaaccagatgtacctcgaggcgggcaacctgaccgttgaactgctcgggcgcggatttgcctggctggataccggcactcacgacagcctgattgaggccagcacttttgtgcagacagtagaaaaacgccagggctttaagattgcctgcctggaagagatcgcctggcgtaacggctggctcgatgacgagggtgtgaagcgtgctgccagttcattagcgaaaactggctacggccaatatctgctggagttacttcgtgcccgtccgcgccagtattgagccactaacctgggaaaacgccttctttggtgttaacagcgccatcgtgcgcattacgtctgaagcaccgctcctgacgccagacgcgttagcgccgtggtcacgggtgcaggccaaaattgcggcatcaaatacgggtgaactggatgccctgcaacagctgggattctccctggtagaaggtgaagttgatttggcgctacccgtgaacaatgccagtgatagcggtgctgtagtggcacaagagaccgatattcccgcattacgtcagttagccagcgccgcatttgcgcaaagccgttttcgtgcgccgtggtatgcgcctgacgccagcagtcgcttttatgcacagtggattgaaaatgccgtgcgcggcacctttgatcatcaatgtctgattttacgtgcggcgtccggcgatattcgcggctatgtctctttacgggaactcaatgcgacagatgcgcgaattggcctgctggctggacgcggtgcaggtgctgagctgatgcaaacggcgctaaactgggcgtatgctcgcggtaaaacaactttgcgggtggcgacccagatgggcaacaccgccgcgcttaaacgatacatacaaagtggtgcgaatgtagaaagcaccgcgtactggttatacaggtgatcacatgattccatttaacgcaccgccggtggtgggaaccgaactcgactatatgcagtcggcaatgggtagcggcaaactgtgtggcgatggcggttttacccgtcgctgccagcagtggctggagcaacgttttggcagcgccaaagtgttactgacgccgtcctgcaccgcttcgctggagatggcggcgctgctgctcgatatccagcctggcgatgaagtgatcatgccgagctacacctttgtctccaccgccaatgcctttgtgctgcgtggcgcaaaaatcgtttttgtggatgttcgcccggacaccatgaacatcgacgaaacgctgattgaagcggcgatcaccgacaaaacgcgcgttatcgtgccggtccattacgcgggtgtggcctgcgaaatggacaccattatggcgttggcgaaaaagcataatctttttgtggtggaagatgccgctcagggcgtgatgtccacttacaaagggcgtgcactgggaaccattggtcatattggctgctttagcttccatgaaaccaaaaactacacggcgggtggtgaaggcggcgcgacgctgattaacgataaagcgttaatcgaacgagccgagatcatccgtgaaaagggcactaaccgcagccagttcttccgtggtcaggtcgataaatatacctggcgcgatattggctccagctatttgatgtccgatctgcaagctgcgtacctgtgggcgcaactggaagcagcggatcgtatcaaccagcaacgtctggcgctgtggcaaaactactacgatgcgttagcgcctctggcgaaagccgggcgtatcgagctgccgtcgattcccgatggctgcgtgcagaacgcgcatatgttctacattaaactgcgggatattgatgaccggagcgcgttgattaactttctgaaagaagcggaaatcatggcggtgtttcattacattccgctgcacggttgccctgcgggggaacactttggtgagttccacggtgaagatcgctacaccaccaaagagagcgagcgcctgctgcgcctgccgctgttctacaacctgtcgcccgtcaatcagcgtacggtaattgcgactttgttgaactacttctcctgatatgtcgttggcaaaagcgtccttgtggacggcggccagtacactggtcaagattggtgccgggttactggtcggtaagttgctggctgtgtcatttggtccggcggggcttgggctggcggcaaatttccgccagttgattaccgtgctcggcgtgcttgccggagctggcatctttaacggtgtaaccaaatacgttgcccagtaccatgataatccgcaacagctgcgccgcgtggtcggcacttcatcagcgatggtacttggtttctctacgctgatggcgctggtttttgtgctggcagctgcgccaatcagccagggattgtttggtaataccgactatcaggggctggtgcgtttagtggcgctggtgcaaatggggatcgcctggggcaacctgttactggcgctgatgaaaggctttcgcgatgccgcaggtaatgcgttatcgctgattgtcggcagcttgattggcgttctcgcgtactacgtcagttaccgtttgggcggttatgaaggggcgttgctgggtctggcgctgattcccgcgctggtggtaattcctgccgccatcatgttgatcaaacgtggtgtcatcccgttaagctatctgaaacccagctgggataacggtctggcagggcagttgagcaaatttacgctcatggcgttgattacgtcggtgaccttgcctgttgcttacatcatgatgcgtaaactgctggcggcgcagtatagctgggatgaggtggggatctggcaaggggtgagcagtatttccgatgcctacctgcaatttattacggcatcgttcagcgtatatttgctgcccacgttgtcgcggctaacggaaaagcgcgatatcacccgggaagtggttaaatcgctgaaattcgtcttaccggcagtggcggcggcgagttttaccgtctggctgctgcgtgattttgctatctggctgctgttgtcgaataaatttaccgctatgcgcgatctctttgcctggcagttagtgggtgatgtgttaaaagtgggcgcttatgtctttggttatctggtgatcgccaaagcgtcactgcggttttatattctggcggaagtcagccagttcactttattgatggtatttgcccactggctaatccctgcgcatggtgcactgggcgcggcgcaggcatatatggcaacttatatcgtctatttttctctttgttgtggcgtgtttttactctggcgtaggcgggcatgactgtactgattcacgtactgggatcggatatccctcaccataaccgaaccgttttgcggtttttcaatgacgcgctggccgcgacgagcgagcacgcgcgcgagtttatggttgttggcaaggacgacggcttaagtgatagctgtccggcgctttctgtgcaatttttccctgggaaaaaatcgctggcggaagcggtcatcgcgaaagcaaaagctaaccgtcagcagcgttttttcttccacggtcagttcaatcccacactgtggctggctctgctgagtggtggcattaagcccagccagtttttctggcatatctggggggcagacctgtatgagctttccagtggcttgagatataagcttttttacccactacgtcgcctggcgcaaaagcgagtcggctgtgtatttgccacccgcggcgatttgagcttttttgtcaaaacgcatccaaaggtgcggggcgaactgctgtacttcccgacgcggatggacccttctctcaatacgatggcgaacgatcggcaacgtgaagggaaaatgaccattctggtggggaactccggcgaccgcagcaatgagcatgtcgccgccttacgtgccgttcatcagcaatttggcgatacggtaaaagtggtggtgccgatgggatatccgcctaataacgaagcgtacattgaggaagttcgtcaggcggggctggagttattcagcgaagaaaatctgcaagttctgagcgaaaaactggaatttgacgcctatctggcgctacttcgtcagtgcgatctcggttactttatttttgcccgccagcagggcattggtacgctgtgcttactgattcaggcgggcattccttgtgtgcttaaccgggaaaatccgttctggcaggatatgacggaacagcatttgccggtgctgtttactaccgacgatctcaacgaggatattgtgcgtgaagcgcagcgccagttggcgtcggtggataaaaacaccattgccttctttagccctaactatctacaaggctggcagcgggcgttggcgattgccgccggggaggtcgcatgagtctgctgcaattcagtggcctgtttgtggtctggctgctctgcacgctgtttattgccacgctgacctggtttgagtttcgccgtgtgcgctttaacttcaatgtcttcttttcattgctgtttttgctcacctttttcttcggcttcccgctgaccagcgtgctggtatttcgctttgatgttggtgtcgcgccgccagaaatcttgttgcaggcgttgctttctgcgggctgcttctacgcggtttactatgtcacctacaaaacccgcctacgcaaacgcgttgctgatgtaccgcgccgtccgctgtttaccatgaatcgcgtggagaccaatcttacgtgggtgatcctgatgggtatcgcgctggtaagcgtcggcatcttcttcatgcacaacggctttttgctgttccggcttaactcctacagtcagatcttttccagtgaagtctccggcgtggcgttaaaacgcttcttttactttttcatcccggcgatgctggtggtctactttctgcgccaggacagcaaagcgtggctgtttttcctcgtcagcacggtcgcctttggcttgctgacttatatgattgtcggtggcactcgcgccaatatcatcatcgcattcgctatcttcctgtttattggcattattcgcggctggatttcgttgtggatgctggcggcggcgggcgtgctggggattgttggcatgttctggctggcgctaaaacgctatggaatgaatgtgagcggcgatgaagcgttctatacgtttctctatctcactcgcgacaccttctcgccgtgggagaatctggcgttgctgttgcagaactacgacaacatcgacttccagggcctggctccaattgtccgcgatttctatgtctttatcccttcctggctgtggccgggtcgcccgagtatggtgctgaactccgccaactactttacctgggaagtgctgaataaccactccggactggcgatctcgcctacgcttataggctcactggtggtgatgggcggcgcgttgttcatcccgctcggggcgattgtggttggactgatcatcaaatggttcgactggctgtatgagctgggcaaccgcgagactaatcgctataaggctgcgatattgcacagtttctgctttggggcgatcttcaatatgatcgtgctggcacgtgaagggctggattcgtttgtctcacgcgtagtcttttttatcgtggtcttcggcgcatgtctgatgatcgcaaaactgttgtactggctttttgaaagcgccggactcattcataaacgtacaaaatcatcgctccggacgcaggttgaaggataacaatgaataacaacaccacggcaccgacctatacgctgcgtggcttacagttgattggttggcgtgatatgcagcacgccctcgattatctgtttgctgacgggcatcttaagcagggaacgctggttgccattaatgccgaaaaaatgctgaccattgaagataatgctgaggtcagggagctaattaacgctgccgaatttaaatatgcggatggcatcagcgttgtacgttcagtacgtaaaaagtacccgcaggcgcaggtttcccgcgttgccggtgccgatctctgggaagagctgatggcgcgcgcaggcaaagaagggacgccggtatttcttgtgggcggtaaacctgaagtgctggcgcaaactgaagctaaactgcgcaaccaatggaatgtgaatatcgttggcagtcaggatggttattttaaacccgagcagcgtcaggcgctgtttgaacgcattcatgccagcggagcgcaaatcgtcaccgttgcgatgggatcgccaaagcaggagatcttcatgcgcgactgccgtctggtgcatccagatgcgctgtatatgggcgttggcgggacttacgatgttttcaccggtcacgtaaaacgcgcaccgaaaatctggcaaacgctgggactggagtggctctaccgcctgctttcgcagccgagccgcattaagcgtcagcttcgtttgctgcgttatttacgctggcattacaccggcaacctctgattttcctctctttgtaaagcgacggagtggtcacttcgtcgcctgtctgcttttttattacacaaagcattcaaatttttaatgctttatttgccatttctcctgaattacgaaaacattcgcaacactcgatgtacccataacgataaccggtaacaccggaaagcatgcaaacacaacacgaggatttatggcagataacaaaccagagctacagcgtgggctggaagctcgacatatcgaactcatcgccctggggggcaccattggcgtcggcctgtttatgggggccgccagtaccctgaaatgggccgggccatccgtattgttggcctatatcatcgccgggctgttcgtctttttcatcatgcgttcaatgggcgaaatgttgttcctcgaaccggttaccggttcgttcgccgtttatgcgcatcgttatatgagcccgttttttggttatctcaccgcctggtcttactggtttatgtggatggcggtggggatctcagaaatcaccgccattggcgtttatgtccagttctggttcccggagatggcgcagtggatacccgcattgatcgcagtggcgctggtggcgttggcgaatctggcggcggtgcggttgtacggcgaaatcgagttctggttcgcgatgatcaaagtcaccacgattatcgtgatgattgtcattggcctgggcgtgattttctttggctttggcaatggcgggcagtcgattggttttagcaatctcacagagcatggcggtttctttgcgggtggctggaaagggttcctgaccgcgctgtgtattgtggtggcgtcctaccagggcgtggagctgattggcattactgccggtgaagcgaagaatccgcaggtgacactgcgcagtgccgtaggcaaagtgctgtggcggatcctgattttctacgtaggcgcgattttcgttatcgtcaccatcttcccgtggaatgaaattggcagcaacggcagcccgttcgtactgacttttgccaaaatcggtattaccgcagcggcgggcattatcaactttgtggtgctgacggctgcgctctctggctgtaacagcggcatgtacagttgcggacgtatgctctacgcactggcgaaaaaccgtcagttaccggcggcgatggcgaaagtttcccgtcacggcgtaccagttgcgggtgtggcagtatctattgctattctgctaattggctcatgcctgaactacatcattcccaatccgcagcgtgtgtttgtctacgtctacagtgccagcgtgcttccggggatggtgccatggtttgtgatattgataagccagctgcgttttcggcgtgcacataaagcggcgattgccagccatccgttccgctcaatcctgttcccgtgggccaactacgtaacaatggcattcctgatttgcgttttgatcggcatgtactttaatgaagatacgcgtatgtcgctgtttgttggcatcatctttatgctggcggtgacggcgatttataaagtttttggccttaatcgccacgggaaagcgcataaactggaggaataagcagcaaaacgcacaaaccgtaaccaaacgcgcaatttatttaaaaagggactagacagaggggtgggaagtccgtattatccacccccgcaacggcgctaagcgcccgtagctcagctggatagagcgctgccctccggaggcagaggtctcaggttcgaatcctgtcgggcgcgccatttattcccggcgcttgagctgcggtggtagtaataccgcgtaacaagatttgtagtggtggctatagctcagttggtagagccctggattgtgattccagttgtcgtgggttcgaatcccattagccaccccattattagaagttgtgacaatgcgaaggtggcggaattggtagacgcgctagcttcaggtgttagtgtccttacggacgtgggggttcaagtcccccccctcgcaccacgactttaaagaattgaactaaaaattcaaaaagcagtatttcggcgagtagcgcagcttggtagcgcaactggtttgggaccagtgggtcggaggttcgaatcctctctcgccgaccaattttgaaccccgcttcggcggggttttttgttttctgtgcatttcgtcaccctcccttcgcaataaacgcccgtaataactcattgccccacggtatgatttcgcccttaacgtattgaaggatgacttcaggcaaggagtgaccatgctgcaacaggttccaacgcgtgcttttcatgtgatggcgaaaccgagtggttccgattgtaatctgaactgtgactactgtttttatctcgaaaaacaatccctttaccgcgaaaagccagtcacgcatatggacgatgacacgctggaagcgtatatccgtcactatatcgccgccagcgaactgcaaaacgaagtggcttttacctggcagggcggcgaaccaacgctactcgggctggagttttaccgccgtgccgtagcgctacaggcgaaatatggtgctggcaggaagataagtaacagcttccagactaacggcgtgctgctggatgacgaatggtgcgcgtttctcgcggagcatcattttcttgttggtttatcgctggatggtccgcctgagatccacaatcaatatcgcgtgactaaaggtggcagacccacgcataagctggtgatgcgtgccctgacgctgctgcaaaaacatcatgtcgactataacgtgctggtctgcgttaatcgcaccagcgcgcagcaaccgttgcaggtatatgattttttgtgcgatgcgggagtggaattcatccagtttattccggtggtcgagcgcctggctgatgaaacggctgcccgcgaaggactgaaattgcatgcgcctggtgatattcagggtgagctaacggaatggtcggtgcgccccgaggagttcggtgaatttctggtggcgatattcgaccactggatcaaacgcgacgtcggcaagattttcgtgatgaatatcgaatgggcgtttgccaattttgtcggtgcgccgggtgcggtttgccatcatcagccaacctgtgggcgctcggtgattgttgagcacaacggcgacgtttacgcctgcgatcactatgtttatccacaatatcggctggggaatatgcaccagcaaacaattgcagaaatgatcgattccccgcaacagcaggtgtttggtgaagataaatttaagcaattaccggcgcagtgtcgcagttgtaacgtgttaaaagcgtgctggggaggctgcccgaaacaccgcttcatgctcgatgccagcggcaaaccggggctgaattatttgtgtgccgggtatcagcgttatttccgccatctaccgccatatcttaaagcaatggctgatttgctggcgcacggtcgcccggccagtgacattatgcatgcgcatttgctggtggtgagtaagtaaaaaagcggccattttgtggccgcctgcggttgattgccggatgcggcgtaaacgccttatccggcctacatgatcgtgcaaattcaataaattgcagcgttctgtggatactggtttgggtgatcgtatccggcaaagcctttgcgtgcggtggcagttgacggggtatctgctgcgctggccatgagaggaagagcggcggcgacagcaacaacaagaagtttgggtgaaaacgaaaattccatgcaaaatgctccggtttcatgtcatcaaaatgatgacgtaattaagcattgataattgagatccctctccctgacaggatgattacataaataatagtgacaaaaataaattatttatttatccagaaaatgaattggaaaatcaggagagcgttttcaatcctacctctggcgcagttgatatgtaaggcaggtttattatatcgcgttgattattgatgctttttttagttttaacggcaattaatatatgtgttattaattgaatgaattttatcattcataataagtatgtgtaggatcaagctcaggttaaatattcactcaggaagttattactcaggaagcaaagaggattacagaattatctcataacaagtgttaagggatgttatttcccgattctctgtggcataataaacgggtagatgctcattccatctcttatgttcgccttagtgcctcataaactccggaatgacgcagagccgtttacggtgcttatcgtccactgacagatgtcgcttatgcctcatcagacaccatggacacaacgttgagtgaagcacccacttgttgtcatacagacctgttttaacgcctgctccgtaataagagcaggcgtttttttatgcatcagaaaggtcccggaggtgcttgcctccgggtgagaaggaactactgtggtgggttgttctgcaacgttaacatcaaaccgtcgcgacgcatcgctgcagcttcttccggcttgtgcagtctgtccagcgcgtcggcaagccatgcgtaatcgtaggcgtccggacgttgtttcagcgccgcgcggaaggcgagcgatgcttcctgccattctccgtgcttcatcagtgactggcccagtgtgctccacaacagcgggcgatcgccgacgtttttgatctgctggcgtagcactttttccagctgttccgggttattggttttcagacgcgggatcggcagcagtaggcgatcgtcatactggcgtttcaggccgtcgatgataatttgctgggcagtatcatgatcgtcacattcaataagatgttccgccattgccacctgcaacgctacctgatgacgcgttttccggctttggtttttccaccagttacgcaaaccttcgctaccgttatcggcacgagcctgatccatcaggccaatccatgcctgttgttccagcattgcacgatgttcttcatcaccaacatgggctttcgccattgatgggataatatccagcagcgaactccatgcacctgtgcggatatacgcctgttccgccagacgtaatacttccggatggcgtggcgtaacttccagcagcttatccacgccgtggcgtgcagcatggttttcattacgggccagttgcagacgtacacgggtgatttctaccggaatggtgtcattgccggccagctccgctgcgcgttccagatgttggttggcgcgcgcttcatcaccacgttgttgcgcggcttcggcagccagtagatagttcaccaccggttgttcagcgtgatcggcatttttcgccatcagcttttcaacttgctgataatcgccttccgccagtttcagcagcgcctgttcggtctgcttacgtgcacggcgacgcttacgcccgacaaaccacccacgggtgtgcgcgccagtgcggaagatccgccgcagtagccactcaatggcaaacagcactaccatcgccagaatcaatatgatcgccaggcccgtgacgctggtttcgatattgtagttgtcggtttggatcagcacataaccctgatgaccggcaatcatcgggccaaccactatccccgcaatcagcaaaacaaagagtaataacacttttagcatggttattctccttgcggcgcggctgccggagtatcaccttgcggtgcaggtttagcttccgttgtccctgctgccggttgtgccagcaggttacgcacgcgagtctgcatcagtttttccagcatcgcctggctttgcagggtttccggaagatccatcgagatattttgctggcttaactggtccacctcgtcgaggaacgctttggtggtggcatcatcagtatcgtagtaagcacgtacccaggtggagacgttctccagcgcctggcgataagtctcttcctggtgacgcggtacagcttgtgctgcgaccagcaggcgagagcgaatattttcgcgcagatagatatcctgatttggcgctaacagcggtacggcggtgtcatcacgacggcgaatcgtaatgaagttgtccataaagttctgccagcttttttgcagattgatacgccattcgctgatggaactggaaagctcttcaccgtctgaatccatcggcgaaccatcgctgtcattatcggccagacgcaggttatctacctgatttgaaagctgattaagcttaaggatgatgccgtcataatccacctgcgatactgcagaaaggctggcgatatcatcggtaattgcccgacgaacggtaatcagactcgggtcattcatatccgccaggctggcgtctgcacttttcagcaacgctgcagcggtcgtgacgtcctgatcgctccacagcttccgtccggcgagtttcaccagaaaatcggcctgagccagcagccaggttttagcatcgctgccggaaatggtggcgaccttttgttggacttcatccaactgttttgccagcgtttcttgctgacgattcgcctgcttaagttgtgcagcttgttgcttaataatgccttccagctcggctttttggctctcctgggctttttgcaatgccgtcagttggttagccagggcatcgctggtggcggtctgattgacggcctgttgtttaccccagccatacaaaccgacgcccgccgccagagcaatagcgatagccaccgcgctgagaatcaatgcggtattgttcttactctttttttctgttgcgacaggttgtgacgtggtgtccacggcctccctggtctcttcaaccacggcggaggttttttcttgttccgtcattatggcttcctgttatgagagttattgtaatgcccgtaaaagcgcatcgttgtcagcgttatcggcgaccttaatgtcttgccagcccagttcccgggcgagtttcgccaaacgctcactgacgaccaatagtcgacagtgtagtaaccagtgctcacgataccattgtgggatcagcgaccagagttgctgcaacatttcaccgctggtaacaacgaccgtcgtcacctcgcgggattgccagcgcatcgcttcttcggcaccatcgtaatggattgcgcatcgttgataacattcacaaaaagtgacctcagcaccgcgcgccgtcagggtatccccaattagctcacgaccgccattgccacgtaatatcagcgcacgtttgcccgcaatattttgtaattcaggtaattgtagcaagacttcgctgatttcccgatcctgcgggtagagaatcttctgtccgcttacggtatgtagtgccagtgcggtggtgcgtccaatggcgaaataattaggtagtcggggccatttacgatcttgctgatgtagctgtgattgggcaaaagcaaccgcgtgttgcgagagggcaaacaacagatcgctctcccccagcgctgccagttgatcagcaagttgcggtaattgtcgacccggagaaaactcaatcagcggaaaatgccaggccacctgccccagtgtgcgcagacggctcactaactcttctccagcgggagacgggcgggtgaccaggatactcatgccggggcgtctccgttatagacttcagcgaggatctcgcgcgcgccgttattcagtagctcttctgccagcgaaatccccatttgttcggcatcttgcggcgcaccgcggcgttcaccgcgaataatctgcgaaccgtccggcgcgccgaccagcgcacgcagccagatttcgccatcaataagctcggcgtagctaccaattggcacctgacatccgccttcgagacgggtattcatggcgcgttctgcggtaacgcgcagtgcagtttcgtggtgattcagcgcggcaagcagctcgcgagtgcgtgaatcatcaaggcggcattcaatacccaccgcaccttgtcctaccgccggaagagaaatctcgggtggcaacgcggcgcgaatacgtgactccagacctaaacgttttagtccggctacggcaagaatgatggcatcgtattcgccgttatccagtttgctcaggcgagtgccgacgttgccgcgcagggagcggataatcagatccggacggcgttcagccagttggcactggcgacgtaaactggacgtcccgacgatactgcctgccggtaacgcatccagactgtcatagttattggacacaaaggcatcgcgaggatcttcacgctcacaaatagtgaccagtcccagaccttgcgggaattcaaccggcacatctttcattgaatgtacggcgatatcggcgcgattttcgaggagcgcgacttccagctcttttacaaataagccttttccgcctactttcgccagcggcgtatcaagaatcacatcgccgcgcgtcaccatcggtaccagttcaacgaccaggcccggatggctcgccatcaacttgtctttgacatagtgtgcctgccagagtgcaagtgggctttggcgtgtggcaattcttaaaacattgtctaacatgcttgttaccgtcattatcatccgtggtccatcctaacatccttgccagagtgatgtcagtgttgtggtgaaacgtagacgcctgcgcaaaccgtaaaatgaggtctggcagtggatcctgacaggcgtttcacgccgtcgtaataaggaatttacagagaataaacggtgctacacttgtatgtagcgcatctttctttacggtcaatcagcaaggtgttaaattgatcacgttttagaccattttttcgtcgtgaaactaaaaaaaccaggcgcgaaaagtggtaacggttacctttgacatacgaaatatcccgaatgccgcgtgttaccgttgatgttggcggaatcacagtcatgacgggtagcaaatcaggcgatacgtcttgtacctctatattgagactctgaaacagagactggatgccataaatcaattgcgtgtggatcgcgcgcttgctgctatggggcctgcattccaacaggtctacagtctactgccgacattgttgcactatcaccatccgctaatgccgggttaccttgatggtaacgttcccaaaggcatttgcctttacacgcctgatgaaactcaacgccactacctgaacgagcttgaactgtatcgtggaatgtcagtacaggacccgccgaaaggtgagcttccaattactggtgtatacaccatgggcagcacctcgtccgtagggcaaagttgttcctctgacctggatatctgggtctgtcatcaatcctggctcgatagcgaagagcgccagttgctacaacgtaaatgtagcctgctggaaagctgggccgcctcgctgggtgtggaagtcagcttcttcctgattgatgaaaaccgtttccgtcataatgaaagtggcagtctggggggcgaagattgtggctccacccagcatatactgttgcttgacgaattttatcgtaccgccgtgcgtctcgccggtaagcgtattctgtggaatatggtgccgtgcgacgaagaagagcattacgacgactatgtgatgacgctttacgcgcagggcgtgctgacgccaaatgaatggctggatctcggtggcttaagctcgctttctgctgaagagtactttggtgccagcctttggcagctctacaagagtatcgattccccatacaaagcggtactgaaaacactgctgctggaagcctattcctgggaatacccgaacccacgtctgctggcgaaagatatcaaacagcgtttgcacgacggcgagattgtatcgtttggtctcgatccatactgcatgatgctggagcgtgttactgaatacctgacggcgattgaagattttacccgtctggatttagtacgtcgctgcttctatttaaaagtgtgcgaaaagctcagccgtgaacgcgcctgcgtaggctggcgtcgcgcagtgttgagccagttagtgagcgagtggggttgggacgaagctcgtctggcaatgctcgataaccgcgctaactggaagattgatcaggtgcgtgaggcgcacaacgagttgctcgacgcgatgatgcagagctaccgtaatctgatccgctttgcgcgtcgcaataaccttagcgtctccgccagtccgcaggatatcggcgtgctgacgcgtaagctgtatgccgcgtttgaagcattaccaggtaaagtgacgctggtaaacccgcagatttcacccgatctctcggaaccgaatctgacctttatttatgtgccgccgggccgggctaaccgttcaggttggtatctgtataaccgcgcgccaaatattgagtcgatcatcagccatcagccgctggaatataaccgttacctgaataaactggtggcgtgggcatggtttaacggcctgctgacctcgcgcacccgtttgtatattaaaggtaacggcattgtcgatttgcctaagttgcaggagatggtcgccgacgtgtcgcaccatttcccgctgcgcttacctgcaccgacaccgaaggcgctctacagcccgtgtgagatccgccatctggcgattatcgttaacctggaatatgacccgacagcggcgttccgcaatcaggtggtgcattttgatttccgtaagctggatgtcttcagctttggcgagaatcaaaattgcctggtaggtagcgttgacctgctgtaccgcaactcgtggaacgaagtgcgtacgctgcacttcaacggcgagcaatcgatgatcgaagccctgaaaactattctcggcaaaatgcatcaggacgccgcaccgccagatagcgtggaagtcttctgttatagccagcatctgcgcggcttaatccgtactcgcgtgcagcaactggtttctgagtgtattgaactgcgcctttccagcacccgccaggaaaccgggcgtttcaaggcgctgcgcgtttctggtcaaacctgggggttgttcttcgaacgcctgaatgtatcggtacagaaactggaaaacgccatcgagttttatggcgcgatttcgcataacaaactgcacggcctgtcagtgcaggttgaaaccaatcacgtcaaattaccggcggtggtggacggctttgccagcgaagggatcatccagttctttttcgaagaaacgcaagacgagaatggctttaatatctacattctcgacgaaagcaaccgggttgaggtatatcaccactgcgaaggcagcaaagaggagctggtacgtgacgtcagtcgcttctactcgtcatcgcatgaccgttttacctacggctcaagcttcatcaacttcaacctgccgcagttctatcagattgtgaaggttgatggtcgtgaacaggtgattccgttccgcacaaaatctatcggtaacatgccgcctgccaatcaggatcacgatacgccgctattacagcaatatttttcgtgatgaacgtgccggaaagcgaggcttatccggcatgcaatcttagcggaaactgactgtttcacccgcctgctgcgtcgccgcctgttccagcaaatcccagaaggtttcgccgctgcgatcgcaaatccactcatcgcctttcagatcaaaatggtagccgccttgtttggttgccagccatacctggtgcagcggttcctggcggttgataatgattttgctgccattttcaaaggtaatggtcagtacgccgccgttgatttcgcagtcgatatcgctgtcgccatcccagtagtccaggcgttcttcaatggtcagccagagttgatcagccaggcgatgaaattcactgtcgttcattgttgtatcctgtttttaagtgatggcggcagtatagcggtatggggtcagggcttcaaagtttgcacctctgctgctgcgttccggcatgattcatccgtcaccggaataatgatgtctctgttttgaacttcacgtacgttctcctctctgacacgagttttcgccgggcagggggagggcgtaatccttacctctgtatcggtccatgtataaacattgcgatcgtcataagcgaagcgatcgtttttagttagcggaccgttaactggaataatttgcaagctctttgaccgtaattggcggataaagtaagcatgctgtttgccgctattaaatgagcgatcaatgaccaggtctggcgtatccagcgggattatctcaagctggtcttcaccaaatgtcgataattttgttacatacagccgatctttatattgcgcaatattgccagtaatcagatgaaattgttcaggttcaatacctggtaggtctatccacttgctccactgacggtcgggcgtgagctgtttacgccagcgaacgcgactttcccctacttcaaaagagacgtcatcatctacgggtatcgctttgcctgataattgaccaaagggataacgatgcagacccttattgtcgcgaaaaaccagcagtgaatgaggtatccagcgaattatctcaaatgagtctgcattcgccgtaaggtgaacgccatttaaataaatattctgcccactgcggataagcagatcattggaatacgaatttctgtttacactcataagacgtggattaataccccaccatcttttttctaatacagtaacatcactgctgctcccctgacgtcgaccggacaagtagagatttttactatccatcagcgtggtagagttaccttcgatagcttttagtgtcgccagatcaacacgtgacgcgccgctattactttcggtgcgctgtccgtcaaaatagaggctatatttatcgaccgcgaagcggcccatagcctgaaagctggcaatatcgacagtgggggttcccggtggattgctaacgattttgccacgccagagaataacgcggccgtctgtcacccagtggtattcctcattttttatgcttatttcatcggtgggtatatagccttccaccaactcccgctccccggatatatttgtcacaaggcgcaaatcggctctgttcatcttcggaaattgggcaatgattttctcatcctccccataacctttaccgtaagacataacaccgtgatcattgtaatagtcgaaccctatggcctgtacagcaggcgtcagaaatatgtgccccaacaggatgagtgcaactgtgattatttgaccattcattttgtcgcctcattgcgcggggcaggaataaattcgccgtcatcagtaatttttccgtccagatatcccgttttgtaatttacgccatagccatatcccgaatgttgttccttccagattaagcgaacttgtttcggatcagcggtgcggtatcgccagagctgcgcgccatcaaagctgtaaacgtagcggttatcgcgggcataccatctgcgcaaaaagggatggtcattaagatgggcttcgcgttcatccggagagtggttatccagtaagatcagcggtccgtcagattcaaacacgtgtaaaccggaatggtatggccacccttcggcacgcgtaagtaaatagccgtggcgtttcccggcgttgaaacgtttgttgataataagattgggatcatcaagtttcacgatctccagcttgcggtcaccagactctgtttcgatgatggtataaagcgagtcctgatactgggcgacagcatcactgatggggtgaaactgttccggatcgagtccgggtaattcttcctgtttacaagcaggccctttacgccagaacactttcttttccagcagagaaaaatccagacagtgctttgttaaatcttcatcccacgccagattttccttgtcgaggactttacgctgtagcccgtttttatcacgccaggtcaagagtgagccgggcatccagcgtacgacggaaaaggtgttcgggtcggcatcaagctgttcgctgttgatcaggattttggtccgtgtacgagccagggtatcccaggggccaaatggggcaggaaggcagggattgaatgctgtagagaatttaccgcgctgatcccatgatttttgtgccagtaccgtaaaggtgtcaggatcatcaaggcgctgaccatttgcgtaaagataatgcttgtcacggagaatcaaacctagccagtctggtttccattgcgggttaaattctacctgacgcaacgttcggcggtttagttgctggttgctatcggtgcgtttgccttcgtaatagaggctgtacttatctgcggcaaaatcaccccatgcctgaaatgacgagatatcgactggcggtgtgcctggagggttttgcacaatctcgccagcgtagagaatagcgcgaccatcgctatagtaagagtaatggggaagagttgcgtttgcgccgctgtagacaacgtctgtcgtgagatcagtagccgggggcaccgtttcccaatccttcagttttgttgggtcaattaacaaattcggtaacagacgcagacgcttgtagttaatctgcggtagcgaaagattggtcttttcataagggcgcaggtacaccacgccttttccttgtttctggtaaatattatgttccggctcatcaagccgacatccccatgccgatgataagaacaatgaacaagacaacaaacaaaccacattgcgatagtgcataaagccatcctggcgcgaggtgccgatcacgaaactaccagcagaacataattccccgcacgtaagcgtaacttttgcggcaaatcgtcacttttcagaatccataaaggtcattgctattttctgatagttgctgggtaaacgtgatgtttccattcgcgatataaatacgaggtactgcgccatggtgtgactgatcacgttaaaatattccggattgacgccgggaagggtttcaacatgcggctctgcccccgttgcctactttattgtctttcgcgagttgtacccaggtcccaccatcggtatctaacattccccacattattacgctttctgccgaacgtgatttttatagaaatctatcaattcatttttcctgtggcataaagtttatctttcacatcctgccgaacgcgggtcttgtaccccccattgtgaagatcttcatacggagaaaaagaatctttactccaccccagcagcactttatcgccaggcataaaatgcacatgcagaaaatcttctccccattctcttttggggagaggtaacgtcatattccgtttctccagacgcattccagcattatactgtgtacgagtagtacttaatgtccagataacctctgccgtatccccactaacatcaccacaacaggttgttgaaccgccaccatttgcaaaagcattcgcgcccgccacgccgttaacactgaatcccagtatcgggcggtcaatttcactgtggatttccagaatcactccacctcttggtcctccccatactgcctgtcctatattccacaacacgaccagtaccggaacgacaattaacgtccgccatacccagcgcccccaccgggcataaccgcgcgtaagcttttggtcaaatttttccagttgggtaaatagccccatcagattttattccctcttatcaccaggttggcaaagttgtatgtcactggcgactaaggtcagacaacaaaattgcatggtgcgccactcttttaaaagctccatgccgacgataagaacaagccaacaaacaaaccacattgcgatagtgcataaagccatcctggcgcgaggtgccgatcacgaaactaccagcaaaacataaatccccacgagtaagcgttatactcgcagcatttcctcacttttcagacttcataaagagtcgctaaacgcttgcttttacgtcttctcctgcgatgatagaaagcagaaagcgatgaactttacaggcaatccataatgaaaaacgtgtttaaggcactcactgtattacttactctcttcagcctgacgggctgcggtctgaaaggtccgctctatttcccgcctgcagataaaaacgcaccgccgccgaccaaaccggtagagacgcaaacgcaatccacggtgccggataaaaacgatcgcgccactggcgatggtccatcccaggtgaattactaaaagtcagtttctgtacccgcgtgattggagtaaatgatgcagttctcgaaaatgcatggccttggcaacgattttatggtcgtcgacgcggtaacgcagaatgtctttttttcaccggagctgattcgtcgcctggctgatcggcacctgggggtagggtttgaccaactgctggtggttgagccgccgtatgatcctgaactggattttcactatcgcattttcaatgctgatggcagtgaagtggcgcagtgcggcaacggtgcgcgctgctttgcccgttttgtgcgtctgaaaggactgaccaataagcgtgatatccgcgtcagcaccgccaacgggcggatggttctgaccgtcaccgatgatgatctggtccgcgtaaatatgggcgaacccaacttcgaaccttccgccgtgccgtttcgcgctaacaaagcggaaaagacctatattatgcgcgccgccgagcagacaatcttatgcggcgtggtgtcgatgggaaatccgcattgcgtgattcaggtcgatgatgtcgataccgcggcggtagaaacgcttggtcctgttctggaaagccacgagcgttttccggagcgcgccaatatcggttttatgcaagtggttaagcgcgagcatattcgtttacgcgtttatgagcgtggggcaggagaaacccaggcctgcggcagcggcgcgtgtgcggcggttgcagtagggattcagcaaggtttgctggccgaagaagtacgcgtggaactccccggcggtcgtcttgatatcgcctggaaaggtccgggtcacccgttatatatgactggcccggcggtacatgtctacgacggatttattcatctatgaagcaaccaggggaagaactgcaggaaacactcacggagcttgatgaccgggcggttgtcgattatctgattaaaaatcctgagttttttatccgtaatgcgcgcgcagtagaagcgatacgtgtgccgcatccggtacgcggcaccgtttcgttggtcgagtggcacatggcccgcgcacgtaatcatattcatgttctggaagagaacatggcgctgttgatggaacaggctatcgccaacgaaggcctgttttatcgcctactctacctgcagcgcagtctcaccgccgccagcagtctcgacgatatgctgatgcgctttcaccgctgggcgcgcgatctcggcctggcaggtgcgagtctgcgcctgtttccggatcgctggcgcttaggtgcgccgtcgaaccacactcatctggcattaagccgtcagtctttcgaaccgctgcgtattcagcgtttggggcaggaacagcactatcttgggccgcttaacggaccagagctgctggtggtgctaccggaagcgaaagcggtgggatcggtggcgatgtcgatgctgggaagcgatgctgatttgggtgtcgtgctgtttaccagtcgcgatgccagtcactatcaacaagggcaaggaacgcagttacttcatgaaattgcgctgatgttgccggagcttctggagcgttggattgaacgcgtatgaccgatttacacaccgatgtagaacgctacctacgttatctgagcgtggagcgccagcttagcccgataaccctgcttaactaccagcgtcagcttgaggcgatcatcaattttgccagcgaaaacggcctgcaaagctggcagcaatgtgatgtgacgatggtgcgcaattttgctgtacgcagtcgccgtaaagggctgggagcagcaagtctggcgttacggctttctgcgctacgtagcttttttgactggctggtcagccagaacgaactcaaagctaacccggcgaaaggtgtttcggcaccgaaagcgccgcgtcatctgccgaaaaacatcgacgtcgacgatatgaatcggctgctggatattgatatcaatgatcccctcgctgtacgcgaccgtgcaatgctggaagtgatgtacggcgcgggtctgcgtctttctgagctggtggggctggatattaaacacctcgacctggagtctggtgaagtgtgggttatggggaaaggcagcaaagagcgccgcctgccgattggtcgcaacgctgtggcgtggattgagcactggcttgatttgcgcgacctgtttggtagcgaagacgacgcgctttttctgtcgaaactgggcaagcgtatctccgcgcgtaatgtgcagaaacgctttgccgaatggggcataaaacaagggctgaataatcacgttcatccgcataaattacgtcactcgttcgccacgcatatgctggagtcgagcggcgatcttcgtggtgtgcaggagctgctgggtcatgccaacctctccaccacgcaaatctatactcatcttgattttcaacaccttgcctcggtgtacgatgcggcgcatccacgcgccaaacgggggaaataatgcgtttttaccggcctttggggcgcatctcggcgctcacctttgacctggatgataccctttacgataaccgtccggtgattttgcgcaccgagcgagaggcgcttacctttgtgcaaaattatcatccggcgctgcgcagcttccagaatgaagatctgcaacgcctgcgccaggcggtacgggaagcggaacccgagatttatcacgacgtgacgcgctggcgttttcgttcgattgaacaagcgatgctcgacgccgggctgagtgccgaagaagccagtgcaggcgcacacgcagcaatgatcaactttgccaaatggcgcagccgaatcgacgtcccgcagcaaactcacgacaccttaaaacagctggcgaagaaatggccgctggtggcgatcaccaacggtaacgcccagccggagctgtttggtttgggggattattttgagtttgtgctgcgcgctggcccgcacgggcgctcaaaaccgttcagcgatatgtactttttggctgcggaaaaactcaacgtgccgatcggcgagatcttacatgttggggacgatctcaccactgacgtgggtggggcaattcgcagcggaatgcaggcttgttggatcagaccggaaaatggcgatctgatgcaaacctgggacagccgtttactgccgcatctggaaatttcccggttggcatctctgacctcgctgatataatcagcaaatctgtatatatacccagctttttggcggagggcgttgcgcttctccgcccaacctatttttacgcggcggtgccaatggacgtttcttacctgctcgacagccttaatgacaaacagcgcgaagcggtggccgcgccacgcagcaaccttctggtgctggcgggcgcgggcagtggtaagacgcgcgtactggtgcatcgtatcgcctggttgatgagcgtggaaaactgctcgccatactcgattatggcggtgacgtttaccaacaaagcggcggcggagatgcgtcatcgtatcgggcaactgatgggcacgagccagggcggtatgtgggtcggcaccttccacgggctggcgcaccgtttgctgcgtgcgcaccatatggacgccaatctgccgcaggatttccagatcctcgacagtgaagaccagctacgcctgcttaagcgtctgatcaaagccatgaacctcgacgagaagcagtggccgccgcggcaggcaatgtggtacatcaacagccagaaagatgaaggcctgcgtccgcatcatattcaaagctacggtaatccggtggagcagacctggcagaaggtgtatcaggcgtatcaggaagcgtgtgaccgcgcgggcctggtggacttcgccgagctgctgctgcgcgctcacgagttgtggcttaacaagccgcatatcctgcaacactaccgcgaacgttttaccaatatcctggtggacgaattccaggataccaacaacattcagtacgcgtggatccgcctgctggcgggcgacaccggcaaagtgatgatcgtcggtgatgacgaccagtcaatctacggctggcgcggggcgcaggtggagaatattcagcgtttccttaatgatttccccggtgccgaaactattcgtctggagcaaaactaccgctctaccagcaatattctgagcgccgctaacgccctgattgaaaacaataacgggcgtctgggtaaaaaactgtggaccgatggcgcggacggtgagcctatttccctctattgcgcttttaacgaactcgatgaagcgcgttttgtggttaaccgcatcaaaacctggcaggacaacggcggggcgcttgccgagtgcgccattctctaccgcagtaacgcccagtcgcgtgtgctggaagaagcactgttgcaggcgagtatgccgtaccgtatttacggcgggatgcgcttcttcgaacgccaggaaatcaaagatgcgctctcgtatctgcgcctgattgccaaccgtaacgacgacgcggcctttgagcgtgtggtgaatacgccaacgcggggtattggtgaccggacgctggacgtggtacgtcagacatcgcgcgatcgccagttaacactctggcaggcatgtcgtgaactgttgcaggaaaaagccctcgccggacgtgctgccagcgccttacagcggtttatggaactgatcgacgccttagcgcaggaaactgccgatatgccgctgcatgtacagactgaccgggtaattaaagactccggcctgcgtaccatgtacgagcaggagaagggcgaaaaaggtcagacgcgtatcgaaaacttagaggaactggtgacggcaacgcgccagttcagctacaacgaagaagacgaagatttaatgccgctgcaggcgttcctatcccatgcggcgctggaagcaggcgaagggcaggcggatacctggcaggatgcggtacaactgatgaccatgcactcggcgaaaggtctggagttcccgcaggtgtttatcgtcggtatggaagagggcatgttcccaagccagatgtcgctggatgaaggcgggcgtctggaagaagaacgccgtctggcctacgttggcgtaacccgcgcgatgcagaaactgacgctgacctacgcggaaactcgccgtctgtatggcaaagaggtttaccatcgcccgtcgcgctttattggcgagctgccggaagagtgtgtggaagaggtgcgcctgcgcgccacggtaagccgcccggtcagccatcagcggatgggtacgccgatggtcgagaacgacagcggctacaagctcggccagcgtgtacgccacgctaagtttggtgaaggcaccatcgtcaatatggaaggcagcggtgaacatagccgtttgcaggtggcattccagggccagggaatcaaatggctggtggcagcttacgcccggctggagtcggtgtaacgttgccggatgcggtgctgcgcaccttatttggcctaaaaaatcattcagattcaataaattgcaacgtcatgtaggccggatagggcgtttacgccgcatccggcatctgcgccatcttcagtatctgacacaaaactatcgttttaacctttccgctcgacggaaatcatggtgacaaaaggatagcgttgccacgggattgccccgcctttcatatacatatgtgaaatcgtgccatcaagataaagcagctgctcaacgttcagtttcgctttggcataacaggcaaaatcataaaaatttgttgcctgctggctcaacaaaaacacggcgttcccatgtttattaatcccaacaccgttacgaattttgcttgaggcgacgttgggatgaatacgcggattaattacaccgttttccatcaacattggccctgactgcaccgcaaactgaatctctttactggttttgaaggcatccagacgaacgatgccgactttatctcccgcgacataaaacacgccgccaggacggataaagaaattcccttcacctgaagcgagatttaacgccaccttctgctgaccgttttcgatgtacaaaccgagcggcgcatagctttcatcatagatgccgccgttcatcgccatctgcacctgaccctgactattcatatccgccagcagagcatgtaacgttccccacgcttcgccattggctttttgccagtacattttcacccgctctgtttgaggattaacggtatacgcctgtacggtcagcgtcggatctgagagtgcgcaatcatcagcggcaacagcaaacaagggaagtaaggtgagggcgagaaaaatccgtttgagattcaaggtgatcattcctttaccaatgagtagccgatgcgccattataggtcctggatgtgggatttttttatcctgttagcgaccttgacgagtaccaaaaagcgcgaagttcaactattgttctgtggtgttctgttgcgtgttgacggcaaaattttgctggcgtaacatgcgcgcacgatcactctaagaggacattcgccttggacacacccagtagatactggctcactatcctgtcatccaggatcaactcctaaggctatccctttttgctgatagccttagcggttgtcagcgacctcaatttttcccgtcgcgctgagtcaggctgtttaatggtctgaaacccaatttgtttctgtgtgcccaccgaactgtccgatattttaagcattgggagtcccggtcatgctgagcgcatttcaactggaaaataaccgactgacccggctggaagtcgaagagtcacaaccccttgtaaatgcagtatggattgatcttgtcgaaccggacgacgacgagcgactgcgcgtacaatctgaacttggtcagagcctggcaacccgcccggaactggaagacatcgaagcatcggcacgtttctttgaagacgacgacggcctgcatattcactccttcttcttctttgaagatgcggaagatcacgccggtaactccactgtggcatttaccatccgtgatggtcgtctgtttactctgcgtgagcgtgaactgcccgcttttcgtctgtatcgtatgcgtgcccgtagccagtcgatggtggacggtaacgcctacgagctgctgctggatctgttcgaaaccaaaatcgaacagttggcagatgaaattgaaaatatctatagcgacctggagcagttgagccgggtgattatggaagggcatcagggcgatgagtacgacgaggcgctctccactctggcggaactggaagatatcggctggaaagtgcgcctgtgtctgatggatacccagcgtgcgctcaacttcctggtgcgtaaagcgcgtttaccgggtgggcaactggagcaggcgcgtgaaatcctgcgagatatcgaatccctgctgccgcataacgaatccctgttccagaaggtgaacttcctgatgcaggcggcaatgggttttatcaacatcgagcagaaccgcatcatcaaaattttctcggtggtatccgtcgtgttcctgccgccaacgctggttgcctccagctacgggatgaactttgagtttatgccagaactgaagtggagtttcggctacccaggcgcgattatctttatgatcctcgcgggcctggcaccgtatctgtactttaagcggaagaactggttgtaaaaaacgagagcggtggcttagtctggctaagccacctgttattcaaaggctccaggtatttaacccttttacctctttctcatagaaccatttgttcgtgttaacagcaacataggctgctacggcaattcccagaatgttaacgccaattagtgcaccaacaaatagagatagaataccaagtaatagaactataattgcttttttccataaccccaggacaaataaatatatccaggaacagaagaaagcaatgaaattcatttgaatagttaagcgttgtcttacttttaatgctttaaatgctgctttatattctggtgttgccccccagaatccaggaaaaccatgttgatcataaaaattaaatcggtatttccatttttcacttaatgaaccatcgttcatatattccttactcataaatactccataactattgttttgatgaatcagtaggtgcaagcattagcatactgaaagtggaaaaataacaaatcaaaaaaatcatcgaaccattgcctgaacaggcaaaatcttcggctatcattgtgatgatagagatgatatatactgctaatgtaccaaaaacataagtttttatatagatgaaaccactatcacggagtcgctggcaattcatgttgatgacgagataatggagtacgatggtagagactataacaagaaagcctgcttctccatcgttaaaaaagataataagaaaggcaaaaatgaaatttattaaaataaatgaaaatatataacgacgtctggaaatcttaccgttagatgttgggataaatatacgtaacataaattttacatccttgtatgagtctccggtcagcatggcaatatacccactctcatgcaagagtcggcatattttttcagaatatatttattttttatttggacgttctacgctgcgtataaatcgcatccatcacaaaaattgccagcgccacccaaataaaggcgaaagtcaccatcttatcggcacccggtttttcaccataaaacgtcacagccagcaggaacatcagcgtcgggccaatgtactggaaaaagcctaacgttgagagacgcaagcgcgtggcagcggcggtaaaacacaacagcggtacggtagtgacaataccggcggcgatcagcagtaaattcagcgacatcgggttttgccccatatggctggttgagctgtcggcaatagcaaacaggtaaattgccgccacgggcagcagccacatggtttcgattaacatgccggtttgcgcttcaacggcaatcttcttgcgtaccagaccgtagaaggcaaaactaaatgccagtcccagcgcgataataggtagcgaaccaaaagtccacagctggactaacacgccacatatcgccagaatcaccgccagccattgcatccggcggaatcgctcgccgaggaaaatcatccccagcacaatgttcaccagcgggttaataaagtaaccaaggctcgcttccagcatatggtgattgttcaccgcccagataaacagtagccagttgccaccaatcagcacggcagagactgccagcataaaaattttctgtggcgtctgaatcagcgtttttaaataggaccactggcggcaaatgctcatcagcaccaccataaagaaaaacgaccagatcacgcgatgcgtcaggatttcatcggcgggcacgtagtaaatcaacttgaagtacgctggcgctataccccaaataaaataagcggcaagagcgagtaatacgccctgccgcgtttgttttgcatccatcgggaatactcatttttaattggtaacagcagtttacctgcttttatgtcttcaacctaccatataggtggcggtggcactggcaatataaagctgttcttcattgtgtaattcaacgcgggcgacggcgactttattgcctgaacgcaacaggctactagtagcagtaaaacgctcgcccctgcctgggcgcagataatcaacgcgaagatcaatggtccccatccgcgatagccgctggcgtagttcatcttcactgatggtttcgtggcgggttaaggtacttcccacgcacaccagaccggcggcgacatccagcgccgacgcaatgaccccgccgtgcaaaatgctttgcgcccagttgcccaccatcattggctgatttttaaaggccagctgtgcgaactctttttcgtaacgctccagttccatccccaatgcgcggttaaatggcatgtgataaacaaacatctcacccactaatttcagggcttgttcagcggtcagtacggcagacatatcatccttacacttcattggttaatgaaatgttgattttatgcttctttgttgttggtttctactttaggaagggataactaacggctatggagttaagtatgtaaaatagcccgcagaaaaatattcaccttatcaataattcgttacggagaacacgaccgatgcggactctgcagggctggttgttgccggtgtttatgttgcctatggcagtatatgcacaagaggcaacggtgaaagaggtgcatgacgcgccagcggtgcgtggcagtattatcgccaatatgctgcaggagcatgacaatccgttcacgctctatccttatgacaccaactacctcatttacacccaaaccagcgatctgaataaagaagcgattgccagttacgactgggcggaaaatgcgcgtaaggatgaagtaaagtttcagttgagcctggcatttccgctgtggcgtgggattttaggcccgaactcggtgttgggtgcgtcttatacgcaaaaatcctggtggcaactgtccaatagcgaagagtcttcaccgtttcgtgaaaccaactacgaaccgcaattgttcctcggttttgccaccgattaccgttttgcaggttggacgctgcgcgatgtggagatggggtataaccacgactctaacgggcgttccgacccgacctcccgcagctggaaccgcctttatactcgcctgatggcagaaaacggtaactggctggtagaagtgaagccgtggtatgtggtgggtaatactgacgataacccggatatcaccaaatatatgggttactaccagcttaaaatcggctatcacctcggtgatgcggtgctcagtgcgaaaggacagtacaactggaacaccggctacggcggcgcggagttaggcttaagttacccgatcaccaaacatgtgcgcctttatactcaggtttacagcggctatggcgaatcgctcatcgactataacttcaaccagacccgtgtcggtgtgggggttatgctaaacgatttgttttgatgaacggttgagtggttggcaaatctggaacccagcatccaggattaccctctcagagactaaaagcattgcagtttctcgcgcaggcgctgaaaatagcgcctgtttttatttcaggcaatcggggtgaatgtggcgcaggcggaagtgttgaatctggagtccggagctaaacaggttttacaagaaacctttggctaccaacagtttcgccccggccaggaagaaattatcgacactgtgctttccggtcgcgattgcctggtcgtcatgcccaccggtggcggaaaatccctttgctatcaaattcctgccttattgctaaacggccttaccgtggttgtttcaccgctgatttcgttgatgaaagatcaggtggatcaactgcaagccaacggcgtggcggcggcgtgccttaactcgacgcaaacccgcgaacagcaacttgaagtgatgacaggctgccgcaccgggcaaattcgcttactgtatatcgccccggaacgcctgatgctggataactttcttgagcatctggcgcactggaatccggtgttattagccgtcgatgaagcgcactgtatctcccaatggggccacgatttccgcccggaatatgccgcgctcggtcagttgcgccagcggttcccgacgctgccgtttatggcgctgaccgccacagccgacgacaccacgcgccaggatatcgtgcgcctgctggggctgaacgatccgctgattcaaatcagcagttttgaccgtccgaatattcgctacatgctgatggagaagttcaaaccgctcgatcagttgatgcgctacgtgcaggaacagcgcggtaagtcaggcattatctactgcaacagccgcgcgaaagtagaagacaccgctgcgcgcctgcaaagcaagggaattagcgcggcggcctatcatgccgggctggaaaataatgttcgcgccgatgtgcaggaaaaattccagcgcgatgacctgcaaattgtggtggcgacggtggcgttcggcatgggcatcaataaaccaaacgttcgcttcgtggtccactttgatattccgcgcaatatcgaatcctattatcaggaaaccggacgcgccgggcgtgatggcctgcccgcggaagcgatgctgttttacgatccggctgatatggcgtggctgcgccgttgtctggaagagaagccgcaggggcagttgcaggatatcgagcgccacaaactcaatgcgatgggcgcgtttgccgaagcgcaaacttgccgtcgtctggtattgctgaactattttggcgaagggcgtcaggagccgtgcgggaactgcgatatctgcctcgatccgccgaaacagtacgacggttcaaccgatgctcagattgccctttccaccattggtcgtgtgaatcagcggtttgggatgggttatgtggtggaagtgattcgtggtgctaataaccagcgtatccgcgactatggtcatgacaaactgaaagtctatggcatgggccgtgataaaagccatgaacattgggtgagcgtgatccgccagctgattcacctcggcctggtgacgcaaaatattgcccagcattctgccctacaactgacagaggccgcgcgcccggtgctgcgcggcgaatcctctttgcaacttgccgtgccgcgtatcgtggcgctcaaaccgaaagcgatgcagaaatcgttcggcggcaactatgatcgcaaactgttcgccaaattacgcaaactgcgtaaatcgattgccgatgaaagcaatgtcccgccgtacgtggtgtttaacgacgcaaccttgattgagatggctgaacagatgccgatcaccgccagcgaaatgctcagcgttaacggcgttgggatgcgcaagctggaacgctttggtaaaccgtttatggcgcttatccgcgcgcatgttgacggcgacgacgaagagtagtcagcggcataaaaaagtgccaggatgaagactccgtaaacgtttcccccgcgagtcaaatgtatgttgatgttatttctcaccgtcgccatggtgcatattgtggcgcttatgagccccggtcccgatttcttttttgtctctcagaccgctgttagtcgttcccgtaaagaagcgatgatgggcgtgctgggcattacctgcggtgtaatggtttgggctgggattgcgttgcttggcctgcatttgattatcgaaaaaatggcctggctgcatacgctgattatggttggcggtggcctgtatctctgctggatgggttaccagatgctacgcggtgcactgaaaaaagaggctgtatctgcgcctgcaccacagattgagctggcgaaaagcgggcgcagttttctgaaaggtttactgaccaatctcgctaatccgaaagcgattatctactttggctcggtgttctcattgtttgtcggtgataacgttggcactaccgcgcgctggggcatttttgcgctgatcattgtcgaaacactggcgtggtttaccgtcgttgccagcctgtttgccctgccgcaaatgcgccgtggttatcaacgtctggcgaagtggattgatggttttgccggggcgttatttgccggatttggcattcatttgattatttcgcggtgatgccagacgcgtcttcagagtaagtcggataaggcgtttacgccgcatccgacattatttttcacgcatgcctcgccgatgctaacagcgctcccaccagcataaacaacgagccgaaaatcttattcagcgccttcatctgctttggtcctttaatccatagagcaatccgttgagcaagggtggcgtaaccgatcatcacaataatatcgactacaatagtggtgacgccgagcacgatatactgcatcagttgcggctgctgtggcatgatgaattgcggaaatagcgccgccagaaacacaatacttttgggattggtgagattcacaaaaactgcgcgctggaacaaatgtcgacgcgattgagtagaggccagcgatttaaggtcaattgcaccagcggcgcgccactgctggattcccagccaaatcaagtaagccgcgcctgcccacttcaacacttcaaacgcaatcactgagcgggaaaatagcgtccccaaccccacgccaaccagcacaatatgaatcgccagtccggtctgaagcccagcaatagacgccaccgcgccgcgataaccgtggttgagcgaggtggtcatagtgttgattgcaccagagcctggcgacaggcttaaaatgatcgatgtcagcaggtaggcaaaccaccattctaaggtcatgatgaactcccggtgtgtctatttttgtgccacaatacgctactgtcgcagcgttgtgtcaggcacgctaaaaaaaacgattttacgtggtttaagaggcagattacccgatgtttcagcagcaaaaagactgggaaacaagagaaaacgcgtttgctgcttttaccctgggaccgctgactgatttctggcgtcagcgtgatgaagcagagtttactggtgtggatgacattccggtgcgctttgtccgttttcgcgcacagcaccatgaccgggtggtagtcatctgcccggggcgtattgagagctacgtaaaatatgcggaactggcctacgacctgttccatttggggtttgatgtcttaatcatcgaccatcgcgggcagggacgttccggtcgcctgttagccgatccgcatctcgggcatgttaatcgctttaatgattatgttgatgatctggcggcattctggcagcaggaggttcagcccggtccgtggcgtaaacgctatatactggcacattcgatgggcggtgcgatctccacattatttctgcaacgccatccaggtgtatgtgacgccattgcgctaactgcgccaatgtttgggatcgtgattcgtatgccgtcatttatggcacggcagatcctcaactgggccgaagcgcatccacgtttccgtgatggctatgcaataggcaccgggcgctggcgcgcgttgccgtttgctatcaacgtactgacccacagcagacagcgatatcgacgtaacttacgcttctatgctgatgacccaacgattcgcgtcggtgggccgacctaccattgggtacgcgaaagtattctggctggcgaacaggtgttagccggtgcgggtgatgacgccacgccaacgcttctcttgcaggctgaagaggaacgcgtggtggataaccgcatgcatgaccgtttttgtgaactccgcaccgccgcgggccatcctgtcgaaggaggacggccgttggtaattaaaggtgcttaccatgagatcctttttgaaaaggacgcaatgcgctcagtcgcgctccacgccatcgttgattttttcaacaggcataactcacccagcggaaaccgctctacagaggtttaaatttcttatgtaccaggttgttgcgtctgatttagatggcacgttactttctcccgaccatacgttatccccttacgccaaagaaactctgaagctgctcaccgcgcgcggcatcaactttgtgtttgcgaccggtcgtcaccacgttgatgtggggcaaattcgcgataatctggagattaagtcttacatgattacctccaatggtgcgcgcgttcacgatctggatggtaatctgatttttgctcataacctggatcgcgacattgccagcgatctgtttggcgtagtcaacgacaatccggacatcattactaacgtttatcgcgacgacgaatggtttatgaatcgccatcgcccggaagagatgcgcttttttaaagaagcggtgttccaatatgcgctgtatgagcctggattactggagccggaaggcgtcagcaaagtgttcttcacctgcgattcccatgaacaactgctgccgctggagcaggcgattaacgctcgttggggcgatcgcgtcaacgtcagtttctctaccttaacctgtctggaagtgatggcgggcggcgtttcaaaaggccatgcgctggaagcggtggcgaagaaactgggctacagcctgaaggattgtattgcgtttggtgacgggatgaacgacgccgaaatgctgtcgatggcggggaaaggctgcattatgggcagtgcgcaccagcgtctgaaagaccttcatcccgagctggaagtgattggtactaatgccgacgacgcggtgccgcattatctgcgtaaactctatttatcgtaatcgttctttatttggtcagttgtcaacctgatacttcgctacaatggatacccgttaatcaaagagttttccattgtggcgctacttatcatcaccacgattctgtgggccttctcctttagcttttatggcgagtaccttgcggggcacgtcgatagctattttgcggtgctggtgcgcgttggcctggcggcactcgtttttctgccgtttctgcgtacccgtggcaatagcctgaaaacagtcggcctgtatatgctggtgggcgcgatgcagctcggcgtgatgtatatgctgagtttccgcgcttatctctacctgacggtttccgaactgctgctgttcaccgtactgacgccgctctacatcacgctgatttatgacatcatgagtaagcgccgtctgcgctggggatatgcttttagtgccttgttggcggtgattggtgccgggattattcgctatgatcaggtcaccgaccatttctggactggcttgttgctggtgcaactctccaatatcacttttgccatcggcatggtgggttacaaacgcctgatggaaactcgcccgatgccgcagcataacgcctttgcgtggttctatcttggcgcgttcctggtggcggtaattgcatggttcttgctgggaaatacgcagaaaatgccgcaaaccacgttgcaatggggcattctggtgtttcttggcgtggtggcttccgggattggctactttatgtggaactacggcgcgacgcaggtggacgccggaacgctgggcattatgaataatatgcacgttccggcagggctgctggtaaacctggctatctggcaccaacagccgcactggccaacgttcattacaggcgcgctggtgatcctggcctcactgtgggtgcatcgtaagtgggtcgctccgcgctcttcacaaacggcagatgatcgcaggcgtgattgcgcgctgagcgaataaacgcttccgtaactggctgacgctgctctccatcgcgcacggcggcgtacagtcggctccacaagccttcgcccagggttttggtcaccaccagaccctggcgctcaaaactctctactacccaatgcggtagcgcggcaatacccatccgtgcggcaaccatctgaatcaacaataaggtgttatcgacgcttttcagtgacgggctgacgcctgccggctgaagaaaatgccgccagacatccagtcgactacgctgtaccggataaatcaacagcgtctcgctggcgagatcttccggtgtaattcgcgttttcgccgccagtggatggtcaggtgctaacaccagacgcacttcatagtcgaacatcggcgaataatgcaggccactgcgcggcaggatatcggaggtcatcaccagatccagctcgccctgttgcaacgcgggctgcgggtcaaacgtcacgcccgatttaaaatccatctctacctgcggccagttcttatggaaattttctaacgcgggcgtcagccactgaatacagctatggcactcaatggcaatgcgcagacgcgtctgctgcggttcattgcaggcttgcagtgcctggctgatttgcggcagcacctggtttgccagttgcaacaggatttctccctgcggtgtaaagcgtagcggctggctcttacgcacaaatagccggaagccaaggcgttgttccagatcgctaaactggtgagacagggcggattgcgtctgatgcaacgtcgccgcagcggctgcgagagagccgcagttccgcaacgcttgtagcgttttcaggtgttttacttcgatcatgaaagtccttcacttcggcatgaataatttgcgcttgaggaatatacagtaaccgccaattatggatgtgtaaacatctggacggctaaatactaaaaattccataaggggcatataatgacaattcttaatcacaccctcggtttccctcgcgttggcctgcgtcgcgagctgaaaaaagcgcaagaaagttattgggcggggaactccacgcgtgaagaactgctgacagtagggcgtgaactgcgtgctcgtcactgggatcaacaaaagcaagcgggtatcgacctgctgccggtgggcgattttgcctggtacgatcatgtactgaccaccagtttgctgctgggtaatgttccgccacgtcatcagaacaaagacggttcggtagatatcgacaccctgttccgtattggtcgtggacgtgcgccgactggcgaacctgcggcggcagcggaaatgaccaaatggtttaacaccaactatcactacatggtgccggagttcgttaaaggccaacagttcaaactgacctggacgcagctgctggaggaagtggacgaggcgctggcgctgggccacaacgttaagcctgtgctgctggggccggttacttacctgtggctggggaaagtgaaaggtgaacagtttgaccgccttagcctgctgaacgacattctgccggtttatcagcaagtgctggcagaactggcgaaacgcggcatcgagtgggtacagattgatgaacccgcgctggtactggaactaccacaggcgtggctggacgcatacaaacccgcttacgacgcgctccagggacaggtgaaactgctgctgaccacctattttgaaggcgtaacgccaaatctcgacacgattactgcgctgcctgttcagggtctgcatgttgacctcgtacatggtaaagatgacgttgctgaactgcacaagcgcctgccttctgactggttgctgtctgcgggtctgatcaatggtcgtaacgtctggcgcgccgatcttaccgagaaatatgcgcaaattaaggacattgtcggcaaacgtgatttgtgggtggcatcttcctgctcgttgctgcacagccccatcgacctgagcgtggaaacgcgtcttgatgcagaagtgaaaagctggtttgccttcgccctacaaaaatgccatgaactggcactgctgcgcgatgcgctgaacagtggtgacacggcagctctggcagagtggagcgccccgattcaggcacgtcgtcactctacccgcgtacataatccggcggtagaaaagcgtctggcggcgatcaccgcccaggacagccagcgtgcgaatgtctatgaagtgcgtgctgaagcccagcgtgcgcgttttaaactgccagcgtggccgaccaccacgattggttccttcccgcaaaccacggaaattcgtaccctgcgtctggatttcaaaaagggcaatctcgacgccaacaactaccgcacgggcattgcggaacatatcaagcaggccattgttgagcaggaacgtttgggactggatgtgctggtacatggcgaggccgagcgtaatgacatggtggaatactttggcgagcacctcgacggatttgtctttacgcaaaacggttgggtacagagctacggttcccgctgcgtgaagccaccgattgtcattggtgacattagccgcccggcaccgattaccgtggagtgggcgaagtatgcgcaatcgctgaccgacaaaccggtgaaagggatgctgacggggccggtgaccatactctgctggtcgttcccgcgtgaagatgtcagccgtgaaaccatcgccaaacagattgcgctggcgctgcgtgatgaagtggccgatctggaagccgctggaattggcatcatccagattgacgaaccggcgctgcgcgaaggtttaccgctgcgtcgtagcgactgggatgcgtatctccagtggggcgtagaggccttccgtatcaacgccgccgtggcgaaagatgacacacaaatccacactcacatgtgttattgcgagttcaacgacatcatggattcgattgcggcgctggacgcagacgtcatcaccatcgaaacctcgcgttccgacatggagttgctggagtcgtttgaagagtttgattatccaaatgaaatcggtcctggcgtctatgacattcactcgccaaacgtaccgagcgtggaatggattgaagccttgctgaagaaagcggcaaaacgcattccggcagagcgcctgtgggtcaacccggactgtggcctgaaaacgcgcggctggccagaaacccgcgcggcactggcgaacatggtgcaggcggcgcagaacttgcgtcgggggtaaaatccaaaccgggtggtaataccacccggtcttttctcattacagcgacttcttcccaccatactgcttaaaccattccagcatacgctgccagccatcttctgcagatgcggcatgatagctcgggcgataatcagcgttgaatgcatgcccggcgtccgggtacacgataatctctgctttcgcattagcagcccgcagcgcctggcgcatggtttcaacgctctcctgcggaatgctgttatcctgaccaccatataagccgagaatcggcgcgttaagatcggttgcgatatcaacaggttgtttcggtgaattcagcgacttgtcgcccgtcagtttgccgtaccacgccactgcggcttttagctgtggattatgcgcggcatacagccaggtgatacgtccaccccagcagaatccggtgatcattaaacgatgaacatcgccgccgttgcgggaagcccaactggcgacatgatcgagatcggccagcacctgcgagtcaggcacttttgctaccagaccgctaagcaacgtggggatatcggcaaaatcattcggatcgccttcgcggaagtaaagttcaggtgcgatagccagatacccctccagcgccagacggcgacaaatgtcgcggatatgttcatgcacgccaaaaatttcctgcactacaatgaccactggcagtgggccatcgctttgctttggtctggcatggtaagcaggcatgttatccccttgtgaagggatagaggtgaagcccgccacaatcgcgtcgtccggggtctgaacgatggtcgaagcgagaggcgatgcagcaggtgcaaatccagattgttgtgttgttgccatggtattctccgtacccttataaaaatgttgcgcaatgttaactatagtcagcatgcaacaaatcacattgcctgaatcggctcatcttttatgcagtcctgcagaatgaagggtgatttatgtgatttgcatcacttttggtgggtaaatttatgcaacgcatttgcgtcatggtgatgagtatcacgaaaaaatgttaaacccttcggtaaagtgtctttttgcttcttctgactaaaccgattcacagaggagttgtatatgtccaagtctgatgtttttcatctcggcctcactaaaaacgatttacaaggggctacgcttgccatcgtccctggcgacccggatcgtgtggaaaagatcgccgcgctgatggataagccggttaagctggcatctcaccgcgaattcactacctggcgtgcagagctggatggtaaacctgttatcgtctgctctaccggtatcggcggcccgtctacctctattgctgttgaagagctggcacagctgggcattcgcaccttcctgcgtatcggtacaacgggcgctattcagccgcatattaatgtgggtgatgtcctggttaccacggcgtctgtccgtctggatggcgcgagcctgcacttcgcaccgctggaattcccggctgtcgctgatttcgaatgtacgactgcgctggttgaagctgcgaaatccattggcgcgacaactcacgttggcgtgacagcttcttctgataccttctacccaggtcaggaacgttacgatacttactctggtcgcgtagttcgtcactttaaaggttctatggaagagtggcaggcgatgggcgtaatgaactatgaaatggaatctgcaaccctgctgaccatgtgtgcaagtcagggcctgcgtgccggtatggtagcgggtgttatcgttaaccgcacccagcaagagatcccgaatgctgagacgatgaaacaaaccgaaagccatgcggtgaaaatcgtggtggaagcggcgcgtcgtctgctgtaattctcttctcctgtctgaaggccgacgcgttcggccttttgtatttttgcgtagcgcctcgcaggaaatgcctttccaactggacgtttgtacagcacaattctattttgtgcgggtaagttgttgcgtcaggaggcgttgtggatttctcaatcatggtttacgcagttattgcgttggtgggtgtggcaattggctggctgtttgccagttatcaacatgcgcagcaaaaagccgagcaattagctgaacgtgaagagatggtcgcggagttaagcgcggcaaaacaacaaattacccaaagcgagcactggcgtgcagagtgcgagttactcaataacgaagtgcgcagcctgcaaagtattaacacctctctggaggccgatctgcgtgaagtaaccacgcggatggaagccgcacagcaacatgctgacgataaaattcgccagatgattaacagcgagcagcgcctcagtgagcagtttgaaaacctcgccaaccgtatttttgagcacagcaatcgccgggttgatgagcaaaaccgtcagagtctgaacagcctgttgtcgccgctacgtgaacaactggacggtttccgccgtcaggttcaggacagcttcggtaaagaagcacaagaacgccataccctgacccacgaaattcgcaatctccagcaactcaacgcgcaaatggcccaggaagcgatcaacctgacgcgcgcgctgaaaggcgacaataaaacccagggcaactggggcgaggtagtattgacgcgggtgctggaggcttccggtctgcgtgaagggtatgaatatgaaacccaggtcagcatcgaaaatgacgcccgctcgcggatgcagccggatgtcatcgtgcgcctgccgcagggaaaagatgtggtgatcgacgccaaaatgacgctggtcgcctatgaacgctattttaacgccgaagacgactacacccgcgaaagcgcgctacaggaacatatcgcgtcggtgcgtaaccatatccgtttgctgggacgcaaagattatcaacagctgccggggctgcgaactctggattacgtgctgatgtttattcccgttgaacccgcttttttactggcgcttgaccgccagccggagctgatcaccgaagcgttgaaaaacaacatcatgctggttagcccgactacgctgctggtggcgctgcgcactatcgccaacctgtggcgttatgagcatcaaagccgcaacgcccagcaaatcgccgatcgtgccagcaagctgtacgacaagatgcgtttgttcatcgatgacatgtccgcgattggtcaaagtctcgacaaagcgcaggataattatcggcaggcaatgaaaaaactctcttcagggcgcggaaatgtgctggcgcaggcagaagcgtttcgcggtttaggagtagaaattaaacgcgagattaatccggatttggctgaacaggcggtgagccaggatgaagagtatcgacttcggtcggttccggagcagccgaatgatgaagcttatcaacgcgatgatgaatataatcagcagtcgcgctagcccattgggagtagttaagccgggtagaaatctagggcatcgacgcccaatctgttacacttctggaacaattttttgatgagcaggcattgagatggtggataagtcacaagaaacgacgcactttggttttcagaccgtcgcgaaggaacaaaaagcggatatggtcgcccacgttttccattccgtggcatcaaaatacgatgtcatgaatgatttgatgtcatttggtattcatcgtttgtggaagcgattcacgattgattgcagcggcgtacgccgtgggcagaccgtgctggatctggctggtggcaccggcgacctgacagcgaaattctcccgcctggtcggagaaactggcaaagtggtccttgctgatatcaatgaatccatgctcaaaatgggccgcgagaagctgcgtaatatcggtgtgattggcaacgttgagtatgttcaggcgaacgctgaggcgctgccgttcccggataacacctttgattgcatcaccatttcgtttggtctgcgtaacgtcaccgacaaagataaagcactgcgttcaatgtatcgcgtgctgaaacccggcggccgcctgctggtgcttgagttctcgaagccaattatcgagccgctgagcaaagcctatgatgcatactccttccatgtgctgccgcgtattggctcactggtcgcgaacgacgccgacagctaccgttatctggcagaatccatccgtatgcatcccgatcaggataccctgaaagccatgatgcaggatgccggattcgaaagtgtcgactactacaatctgacggcaggggttgtggcgctgcatcgtggttataagttctgacaggagaccggaaatgccttttaaacctttagtgacggcaggaattgaaagtctgctcaacaccttcctgtatcgctcacccgcgctgaaaacggcccgctcgcgtctgctgggtaaagtattgcgcgtggaggtaaaaggcttttcgacgtcattgattctggtgttcagcgaacgccaggttgatgtactgggcgaatgggcaggcgatgctgactgcaccgttatcgcctacgccagtgtgttgccgaaacttcgcgatcgccagcagcttaccgcactgattcgcagtggtgagctggaagtgcagggcgatattcaggtggtgcaaaacttcgttgcgctggcagatctggcagagttcgaccctgcggaactgctggccccttataccggtgatatcgccgctgaaggaatcagcaaagccatgcgcggaggcgcaaagttcctgcatcacggcattaagcgccagcaacgttatgtggcggaagccattactgaagagtggcgtatggcacccggtccgcttgaagtggcctggtttgcggaagagacggctgccgtcgagcgtgctgttgatgccctgaccaaacggctggaaaaactggaggctaaatgacgccaggtgaagtacggcgcctatatttcatcattcgcacttttttaagctacggacttgatgaactgatccccaaaatgcgtatcaccctgccgctacggctatggcgatactcattattctggatgccaaatcggcataaagacaaacttttaggtgagcgactacgactggccctgcaagaactggggccggtttggatcaagttcgggcaaatgttatcaacccgccgcgatctttttccaccgcatattgccgatcagctggcgttattgcaggacaaagttgctccgtttgatggcaagctggcgaagcagcagattgaagctgcaatgggcggcttgccggtagaagcgtggtttgacgattttgaaatcaagccgctggcttctgcttctatcgcccaggttcataccgcgcgattgaaatcgaatggtaaagaggtggtgattaaagtcatccgcccggatattttgccggttattaaagcggatctgaaacttatctaccgtctggctcgctgggtgccgcgtttgctgccggatggtcgccgtctgcgcccaaccgaagtggtgcgcgagtacgaaaagacattgattgatgaactgaatttgctgcgggaatctgccaacgccattcagcttcggcgcaattttgaagacagcccgatgctctacatcccggaagtttaccctgactattgtagtgaagggatgatggtgatggagcgcatttacggcattccggtgtctgatgttgcggcgctggagaaaaacggcactaacatgaaattgctggcggaacgcggcgtgcaggtgttcttcactcaggtctttcgcgacagctttttccatgccgatatgcaccctggcaacatcttcgtaagctatgaacacccggaaaacccgaaatatatcggcattgattgcgggattgttggctcgctaaacaaagaagataaacgctatctggcagaaaactttatcgccttctttaatcgcgactatcgcaaagtggcagagctacacgtcgattctggctgggtgccaccagataccaacgttgaagagttcgaatttgctattcgtacggtctgtgaacctatctttgagaaaccgctggccgaaatttcgtttggacatgtactgttaaatctgtttaatacggcgcgtcgcttcaatatggaagtgcagccgcaactggtgttactccagaaaaccctgctctacgtcgaaggggtaggacgccagctttatccgcaactcgatttatggaaaacggcgaagcctttcctggagtcgtggattaaagatcaggtcggtattcctgcgctggtgagagcatttaaagaaaaagcgccgttctgggtcgaaaaaatgccagaactgcctgaattggtttacgacagtttgcgccagggcaagtatttacagcacagtgttgataagattgcccgcgagcttcagtcaaatcatgtacgtcagggacaatcgcgttattttctcggaattggcgctacgttagtattaagtggcacattcttgttggtcagccgacctgaatgggggctgatgcccggctggttaatggcaggtggtctgatcgcctggtttgtcggttggcgcaaaacacgctgattttttcatcgctcaaggcgggccgtgtaacgtataatgcggctttgtttaatcatcatctaccacagaggaacatgtatgggtggtatcagtatttggcagttattgattattgccgtcatcgttgtactgctttttggcaccaaaaagctcggctccatcggttccgatcttggtgcgtcgatcaaaggctttaaaaaagcaatgagcgatgatgaaccaaagcaggataaaaccagtcaggatgctgattttactgcgaaaactatcgccgataagcaggcggatacgaatcaggaacaggctaaaacagaagacgcgaagcgccacgataaagagcaggtgtaatccgtgtttgatatcggttttagcgaactgctattggtgttcatcatcggcctcgtcgttctggggccgcaacgactgcctgtggcggtaaaaacggtagcgggctggattcgcgcgttgcgttcactggcgacaacggtgcagaacgaactgacccaggagttaaaactccaggagtttcaggacagtctgaaaaaggttgaaaaggcgagcctcactaacctgacgcccgaactgaaagcgtcgatggatgaactacgccaggccgcggagtcgatgaagcgttcctacgttgcaaacgatcctgaaaaggcgagcgatgaagcgcacaccatccataacccggtggtgaaagataatgaagctgcgcatgagggcgtaacgcctgccgctgcacaaacgcaggccagttcgccggaacagaagccagaaaccacgccagagccggtggtaaaacctgctgcggacgctgaaccgaaaaccgctgcaccttccccttcgtcgagtgataaaccgtaaacatgtctgtagaagatactcaaccgcttatcacgcatctgattgagctgcgtaagcgtctgctgaactgcattatcgcggtgatcgtgatattcctgtgtctggtctatttcgccaatgacatctatcacctggtatccgcgccattgatcaagcagttgccgcaaggttcaacgatgatcgccaccgacgtggcctcgccgttctttacgccgatcaagctgacctttatggtgtcgctgattctgtcagcgccggtgattctctatcaggtgtgggcatttatcgccccagcgctgtataagcatgaacgtcgcctggtggtgccgctgctggtttccagctctctgctgttttatatcggcatggcattcgcctactttgtggtctttccgctggcatttggcttccttgccaataccgcgccggaaggggtgcaggtatccaccgacatcgccagctatttaagcttcgttatggcgctgtttatggcgtttggtgtctcctttgaagtgccggtagcaattgtgctgctgtgctggatggggattacctcgccagaagacttacgcaaaaaacgcccgtatgtgctggttggtgcattcgttgtcgggatgttgctgacgccgccggatgtcttctcgcaaacgctgttggcgatcccgatgtactgtctgtttgaaatcggtgtcttcttctcacgcttttacgttggtaaagggcgaaatcgggaagaggaaaacgacgctgaagcagaaagcgaaaaaactgaagaataaattcaaccgcccgtcagggcggttgtcatatggagtacaggatgtttgatatcggcgttaatttgaccagttcgcaatttgcgaaagaccgtgatgatgttgtagcgtgcgcttttgacgcgggagttaatgggctactcatcaccggcactaacctgcgtgaaagccagcaggcgcaaaagctggcgcgtcagtattcgtcctgttggtcaacggcgggcgtacatcctcacgacagcagccagtggcaagctgcgactgaagaagcgattattgagctggccgcgcagccagaagtggtggcgattggtgaatgtggtctcgactttaaccgcaacttttcgacgccggaagagcaggaacgcgcttttgttgcccagctacgcattgccgcagatttaaacatgccggtatttatgcactgtcgcgatgcccacgagcggtttatgacattgctggagccgtggctggataaactgcctggtgcggttcttcattgctttaccggcacacgcgaagagatgcaggcgtgcgtggcgcatggaatttatatcggcattaccggttgggtttgcgatgaacgacgcggactggagctgcgggaacttttgccgttgattccggcggaaaaattactgatcgaaactgatgcgccgtatctgctccctcgcgatctcacgccaaagccatcatcccggcgcaacgagccagcccatctgccccatattttgcaacgtattgcgcactggcgtggagaagatgccgcatggctggctgccaccacggatgctaatgtcaaaacactgtttgggattgcgttttagagtttgcggaactcggtattcttcacactgtgcttaatctctttattaataagattaagcaatagcatggagcgagcctcaccatcgggttcggtgaaaatggcctgaaagccttcgaacgcgccttcggtaataatcaccttatcacccggataaggggttgccggatcgacaatgtctttcggtttatataccgatagctgatgaataaccgccgatgggactatcgctggcgacgcgccaaagcgcacgaagtggctgacaccgcgggtcgcgttgatagtcgtggtatgaatcacttctggatcaaattccacaaacaggtagttggggaacaatggctcactgactgcagtacgttttccacgcacgattttttccagggtgatcatcggtgccaggcaattcacagcctgtctttcgaggtgttcctgggcacgttgaagttgcccgcgcttgcagtacagtaaataccaggattgcataatgactcttatccgtttaatcggggcgcaaggatagcaaaagctttacgctaagttaattatattccccggtttgcgttataccgtcagagttcacgctaatttaacaaatttacagcatcgcaaagatgaacgccgtataatgggcgtagattaagaggctacaatggacgccatgaaatataacgatttacgcgacttcctgacgctgcttgaacagcagggtgagctaaaacgtatcacgctcccggtggatccgcatctggaaatcactgaaattgctgaccgcactttgcgtgccggtgggcctgcgctgttgttcgaaaaccctaaaggctactcaatgccggtgctgtgcaacctgttcggtacgccaaagcgcgtggcgatgggcatggggcaggaagatgtttcggcgctgcgtgaagttggtaaattattggcgtttctgaaagagccggagccgccaaaaggtttccgcgacctgtttgataaactgccgcagtttaagcaagtattgaacatgccgacaaagcggctgcgtggtgcgccctgccaacaaaaaatcgtctctggcgatgacgtcgatctcaatcgcattcccattatgacctgctggccggaagatgccgcaccgctgattacctgggggctgacagtgacgcgcggcccgcataaagagcggcagaatctgggcatttatcgccagcagctgattggtaaaaacaaactgattatgcgctggctgtcgcatcgcggcggcgcgctggattatcaggagtggtgtgcggcgcatccgggcgaacgtttcccggtttctgtggcgctgggtgccgatcctgccacgattctcggtgcagtcacccccgttccggatacgctttcagagtatgcgtttgccggattgctacgcggcaccaaaaccgaagtagtaaagtgtatttccaatgacctcgaagtgccagccagtgccgaaatcgtcctggaagggtatatcgatcctggtgagatggcgccggaagggccgtatggtgaccacacaggttactataatgaagtcgatagtttcccggtgtttaccgtgacgcatattacccagcgtgaagatgcgatttaccattccacctataccgggcgtccgccagatgagcccgcggtactgggcgtggcgttgaacgaagtgtttgtaccgattctgcaaaaacagttcccggaaattgtcgatttttacctgccgccggaaggctgttcttatcgtctggcggtagtgacgatcaaaaaacagtacgccggacacgcgaagcgcgtcatgatgggcgtctggtcgttcttacgccagtttatgtacactaaatttgtgatcgtttgcgatgatgacgtcaacgcacgcgactggaacgatgtgatttgggcgattaccacccgtatggacccggcgcgggatactgttctggtagaaaatacgcctattgattatctggattttgcctcgcctgtctccgggctgggttcaaaaatggggctggatgccacgaataaatggccgggggaaacccagcgtgaatggggacgtcccatcaaaaaagatccagatgttgtcgcgcatattgacgccatctgggatgaactggctatttttaacaacggtaaaagcgcctgatgcgcgtttgttttgccctatttatcgatccgacagagaaagcgcatgacaaccttaagctgtaaagtgacctcggtagaagctatcacggataccgtatatcgtgtccgcatcgtgccagacgcggccttttcttttcgtgctggtcagtatttgatggtagtgatggatgagcgcgacaaacgtccgttctcaatggcctcgacgccggatgaaaaagggtttatcgagctgcatattggcgcttctgaaatcaacctttacgcgaaagcagtcatggaccgcatcctcaaagatcatcaaatcgtggtcgatattccccacggagaagcgtggctgcgcgatgatgaagagcgtccgatgattttgattgcgggcggcaccgggttctcttatgcccgctcgattttgctgacagcgttggcgcgtaacccaaaccgtgatatcaccatttactggggcgggcgtgaagagcagcatctgtatgatctctgcgagcttgaggcgctttcgttaaagcaccctggtctgcaagtggtgccggtggttgaacaaccggaagcaggctggcgtgggcgtactggtaccgtgttaacggcggtattgcaggatcatggtacgctggcagagcatgatatctatattgccggacgttttgagatggcgaaaattgcccgtgacctgttttgcagtgagcgtaatgcgcgggaagatcgcctgtttggcgatgcgtttgcatttatctgagatataaaaaaacccgcccctgacaggcgggaagaacggcaactaaaactttattcagtggcatttagatctatgacgtatctggcaaaccatgcccgatgcgacgctgtcgcgtcttatcgtgcctacaaatagtccgaaccgtaggccggataaggcgtttacgccgcatccggcaattggtgcacgatgcctgatgcgacgctggcgcgtcttatcaggcctacattggtgccggatctgtagaccggataaggcgttcacgccgcatccggcaagtggttaaacccgctcaaacaccgtcgcaataccctgacccagaccgatacacatcgtcgccagaccaaactgaacgtctttgcgctccatcagattcagcagcgtggtgctgatacgcgcaccggaacaacccagcggatgacccagcgcgatcgcgccaccattgaggttgatcttctcgtcaatctgctccattagcccgagatctttaatgcacggcaggatctgcgcggcaaaggcttcgttcatctcaaacacgccgatatcgctggcagaaagccccgcttttttcagcgccagctttgaggccggaaccgggccgtaacccataatcgatgggtcacaaccaacgaccgccatcgaacgcacacgagcgcgcggcttaagacctaattcatgggcgcggctttcactcatcaccagcatggcagctgcgccatcggaaagtgcagaagatgtgcccgccgttaccgtaccgtttactggatcaaacgccggacgcagcgtggcgagggcttccacggtggtttccgggcgaatcacttcgtcgtaattaaactgcttcaggacgccgtcggcatcgtgaccaccggtcgggatgatttcatttttaaatgcggccgactgcgtggcggcccaggcacgagcgtgcgatcgcgcggcaaaggcatcctgcatttcacggctgataccgtgcatacgcgccagcatttctgctgttaagcccatcatgcccgccgctttggcgacattgcggctcaggccggggtgaaaatcgacgccgtgactcatcggcacatggcccatatgctccacgccgccaaccagacatgcctgcgcatcgccggtcataatcatccgtgctgcgtcatgcagtgcctgcatggatgaaccacacaagcgattgacggtaaccgccgggacagagtgtggtacttctgccagcagcgccgcgttacgggcgatgttaaaaccctgctccagcgtctgctgcacacaaccccagtaaatatcgtcgagggccgccgcttccagcgccgggttacgcgccagcaggctacgcattaaatgagcggagagatcttctgcacgcacgttacgaaaagcaccgcccttcgaacggcccatcggggtgcgaattgcatcgacaatgacaacctgttccattgtgactccttaagccgttttcaggtcgccaaccggacgggctggctcaaccggaggatagtacggttcgttatgacgcgctttattacgcagaccttccggcacttcatacagcgggccgaggtgctgatattgctgtgccatatcgaggtattttgcgctaccgagggtgtccagccagcggaacgcgccgccgtggaacggagggaagcccaggccgtagaccagcgccatatccgcttccgccggagtggcgataatgccttcctccagacagcgcaccacttcgttgaccatcgggatcatcatgcgggcgataatctcctcttcgctgaaatcgcgcttcggctggctcacttctgccagcaggtcttcaacggcggcgtcttcttctttcttcggcttacctttgctgtcttctttataacgccagaaaccgaggccgttcttctgaccaaagcggttggcatcaaacagcgcgtcgatggcatcgcggtaatctttctgcatccgctgcgggaagcctgctgccatgacagcctgagcgtgatgcgcggtatcaatccccacaacgtccagcaggtatgccggacccatcggccagccaaactgtttttccatcactttgtcgatcttgcggaagtctgcgccgtcgcgcagcaactggctgaatccggcgaagtaggggaacagtacacggttaacgaagaagccggggcagtcgttgaccacaatcggcgtcttgcccatcttgctcgcccatgcgacgactttcgcgatggtttcgtcggagcttttctcgccgcgaataatttctaccaacggcatccggtgcaccgggttaaagaagtgcatcccgcagaagttttccggacgttccagcgcgttggccagttcgctgataggaatggttgaagtgttagacgccagcacggtatcctggcgtactttttgttcggtttctgccagtacggcttttttcactttcgggttttcaacaaccgcttctaccacaacatccacgcggtcaaacccggcgtagtcgagcgttgggtggattgtggagatcacgccagccagtttcagaccatcgatcttgccgcgctcaagctgcttgttcagcagtttcgcggcttcggtcatgccgagggttaacgacttgtcgttgatatctttcatgacaaccggcacgcctttccacgcagactggtaagcgatgccgccgcccataatgcctgcgcccagcacagcggcctgtttcggggtttcaacgtctttggtgagtttcttcgctttgccttttacatattgatcgttaaggaatatgccgaccagtgcgcgagcttcgttggtatgcgccagcgggacaaaacttttgttttccaggtttagggcttcttcacgaccaaaacgggccgcagcttcaatggtttttactgcggtgatgggggccggataatgtttccccgccgtttgtgcgaccatccctttagcgatggtgaagctcatggtggcttcaatcttgctcagttttagcggttccagcttcggctgacgtttcgctttccagtcgaggtcgccgttaatggcctggcgtaaaatcgccatcgccccttcaatcagtttttctgctttgactacgccatccaccagaccgattttcagcgcctgatccgcgccgacatctttaccggcggcaatgatttccagcgcactgtcagcgcccagcatacgtggcatacgtacagaaccgccaaagcccggcatgatgcccagtttggtttccggcagaccgatgcgcagatccggcgtcgccagacgataatcggtcgccagcacgcattcgcagccaccgcccagcgcatagccattgacggcagcaatggtcggcaccggcagatcttccaggcgattaaacacgctattggcaaagtgcagccactgacttaactgttcttcaggaacgaggaacagggacaaaaattcggtgatatcagcaccgacgataaaggctgctttgttcgaacgtagcagcagcccttttagatctgattgctgttccagcacgccgatggcctcgccgaggctggcgacggtcgcagtgtcgagtttattaactgaacctggggcatcaaataccagttcggcaatgccatcttccagccagtcaaggtacagggtgtcgcctttgtaaagcatgtcagtctcctgaatccgcaaggtgatctggtcgtaccagatgagtcgaagtgtgtattttgtgttaaaaatatgcaaacaaaagattaaagaaatgccgatctgatcacgctcggcagaaatcacgctctggatgaacgatgtgctaagatgcggagacttaaggtcaaaaaaacagaagggtaaaaaatggaatcactggcctcgctctataaaaatcatatagctaccttacaggaacggactcgcgatgcgctggcgcgcttcaagctggatgcgttacttattcactccggcgagctgttcaatgtttttctcgacgatcatccctatccgtttaaagtgaacccgcaattcaaagcgtgggtgccggtaactcaggtgccaaactgctggttgctggtggatggcgtgaacaagccgaaactgtggttctatctgccggttgattactggcacaacgtcgaaccgctgccgacctccttctggactgaagatgtggaagtgatcgcactgccgaaagccgatggcattggtagcctgctgcccgctgcgcgcggcaatatcggttatatcggtccggtgccggagcgtgcgctgcaactgggtattgaggccagcaacatcaacccgaaaggggttatcgactacctgcattactatcgctccttcaaaaccgagtacgaactggcctgtatgcgtgaagcgcagaaaatggcggtcaacggtcatcgtgcggcagaagaagcgttccgttctggcatgagcgagttcgatatcaacattgcctatctgaccgcgaccggtcatcgtgataccgacgtaccttacagcaacattgtggcgcttaacgaacacgctgcggtgctgcattacaccaaactggatcatcaggcgccggaagagatgcgcagcttcctgctggatgccggggccgaatataacggctatgcggctgacctgacccgtacctggtcggcaaaaagtgacaacgattacgcacagctggtgaaagacgtaaatgatgaacaactggcgctgatcgcgaccatgaaagctggcgttagctatgtggattaccacatccagttccatcagcgcatcgccaaactgctgcgtaaacatcaaatcatcaccgatatgagtgaagaagcgatggtcgaaaacgatctcaccggaccgtttatgccgcacggtatcggccatccgctgggcctgcaggtgcatgacgtcgccggttttatgcaggatgatagcggtacgcacctcgcggcaccggcaaaatatccgtacctgcgctgcacccgtattctccagccgggcatggtgttaaccatcgaaccgggtatctacttcattgaatcgctactggcaccgtggcgtgaagggcagttcagcaagcacttcaactggcagaaaattgaagcactgaaaccgttcggcggcattcgtatcgaagacaacgtggtgatccacgaaaacaacgtggaaaacatgacccgggatctgaaactggcgtgatggaaagctggttaattcctgcggcaccggtcacggtcgttgaagagatcaaaaagagccgcttcataacactgttggcgcataccgatggcgttgaggcggcgaaagcgtttgttgaatcggtgcgggcagaacaccccgatgcccgccaccattgcgtggcgtgggtggcgggtgcgccggatgattctcaacagctgggtttctctgacgacggggagccggcaggaacggcaggtaaaccgatgctcgcccagctaatgggcagcggcgtcggggaaattaccgctgtggtagtgcgctactacggtggcatattgcttggcaccggtgggttagtgaaagcgtatggcggcggcgtgaatcaggcgctgcgccagctaacgacccaacgcaagacgccattaaccgaatatactttgcaatgtgaatatagtcagttaaccggcattgaagcgttgctggggcagtgtgacggcaaaattatcaacagtgattatcaggcattcgttctgctgcgggtggcgcttccggcggcgaaagtggctgaattttccgcaaagctggcggattttagccgtggttcattgcaattgttagcgattgaagaataatccccacttcgttttgcagaactaaggaagcggcagagatgcattttcgcgccattacccgaatcgttggactactggtcatcttattttcagggaccatgattatccctgggctggtagcactcatctaccgggatggagcgggccgcgcttttacccagaccttttttgtcgccctcgccattggctctatgctgtggtggccgaaccgcaaagagaagggcgaactgaaatcccgtgaggggtttctgatagtggtgctgttttggaccgtgctgggtagtgtcggtgcgctcccttttatcttctcggaaagcccgaacctcacgattaccgatgcgttttttgaatctttctctggcctgaccaccaccggggccactacgctggtggggctggattcgctccctcatgccatcctcttttatcgccagatgctgcaatggtttggcgggatggggatcatcgtgttagcggttgcgatactgcctatcctcggcgtgggtgggatgcagctctatcgcgcagaaatgcccggcccgctgaaagataacaaaatgcgcccgcgaattgcggaaacggcgaaaaccctgtggttgatttatgtcttgctgaccgtcgcctgtgcgctggcgttgtggtttgccggaatggatgcctttgatgccatcggccatagctttgcgactatcgctattggcggcttctcgacacatgatgccagtatcggttatttcgacagcccgactattaacactatcattgctatcttcctgctgatctccggctgtaactacggtctgcacttttcactgttaagtgggcgtagtctgaaggtttattggcgcgatccggaatttcgcatgtttatcggcgtacagtttacgctggtggttatttgtacactcgtactgtggtttcataatgtctacagttcggcgctgatgacaattaaccaggcgtttttccaggtggtatcgatggcgacaaccgccgggtttacgactgacagcattgcccgctggccgctctttttgccggtactgcttttatgttcagcttttatcggcggttgtgccgggtcaacgggcggtggcctgaaagtgatccgcatcctgctgctgtttaagcaggggaaccgtgagctgaaacgactggtgcatccgaacgccgtctatagcattaagctggggaatcgcgcactgccggaacgtatcctcgaagccgtttggggatttttctccgcctatgcattggtgtttattgtcagtatgctggcgattatcgccacgggcgtggatgacttttctgcttttgcctcggttgttgcgacattgaataacctggggccggggcttggcgtggttgctgataactttaccagtatgaacccggtggctaaatggatcctgattgccaacatgctgtttggtcgtctcgaggtctttacattgctggtgctctttaccccgactttctggcgtgaatgatggagtaatacgtgaaaacattaattcttttctcaacaagggacggacaaacgcgcgagattgcctcctacttggcttcggaactgaaagaactggggatccaggcggatgtcgccaatgtgcaccgcattgaagaaccacagtgggaaaactacgaccgtgtggtcattggtgcttctattcgctatggtcactaccactctgcgttccaggaatttgtcaaaaagcatgcgacgcggctgaattcgatgccgagcgccttttactccgtaaacctggtggcgcgtaaaccggagaagcgcactccacagaccaacagctacgcgcggaagtttctgatgaactcgcaatggcgtcccgatcgctgcgcggtcattgccggggcgctgcgttacccacgttatcgctggtacgaccgttttatgatcaagctgattatgaagatgtcaggcggtgaaacggatacgcgcaaagaagttgtctataccgattgggagcaggtggcgaatttcgcccgagaaatcgcccatttaaccgacaaaccgacgctgaaataagcacaaagaataaaaaatgcgcggtcagaaaattattttaaatttcctcttgtcaggccggaataactccctataatgcgccaccactgacacggaacaacggcaaacacgtcgccgggtcagcggggttctcctgagaatctcaacagagaaaagcaaaaaatgcttgactctgtagcgggaaagcgtattatgcacaccccgcgccgctgagaaaaagcgaagcggcactgctctttaacaatttatcagacaatctgtgtgggcactcgaagatacggattcttaacgtcgaaagacgaaaaatgaataccaagtctcaagagtgaacacgtaattcattacgaagtttaattctttgagcatcaaacttttaaattgaagagtttgatcatggctcagattgaacgctggcggcaggcctaacacatgcaagtcgaacggtaacaggaaacagcttgctgtttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagcttgttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgttctttgcagtgctcacacagattgtctgatgaaaatgagcagtaaaacctctacaggcttgtagctcaggtggttagagcgcacccctgataagggtgaggtcggtggttcaagtccactcaggcctaccaaatttgcatcgcaaatttgaagaggttttaactacatgttatggggctatagctcagctgggagagcgcctgctttgcacgcaggaggtctgcggttcgatcccgcatagctccaccatctctgtagtgattaaataaaaaatacttcagagtgtacctgaaaaggttcactgcgaagttttgctctttaaaaatctggatcaagctgaaaattgaaacactgaacaacgaaagttgttcgtgagtctctcaaattttcgcaacacgatgatgaatcgaaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggaggagcccagagcctgaatcagtgtgtgtgttagtggaagcgtctggaaaggcgcgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcatgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagcctgcgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaatcaaggctgaggcgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagtccctcgcggatggagctgaaatcagtcgaagataccagctggctgcaactgtttattaaaaacacagcactgtgcaaacacgaaagtggacgtatacggtgtgacgcctgcccggtgccggaaggttaattgatggggtcagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgttgacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgaccctttaagggtcctgaaggaacgttgaagacgacgacgttgataggccgggtgtgtaagcgcagcgatgcgttgagctaaccggtactaatgaaccgtgaggcttaaccttacaacgccgaagatgttttggcggattgagagaatttcagctttgattcagagtccgaaggattttgcgctgagacaaggcggcaaatgaagcgaaggaaggagcatactgaagtatgtgactgactttcgcgaatgcagccgacgcagtatcagtacaaaagacacaggacagagcacaggaatttgcctggcggcagtagcgcggtggtcccacctgaccccatgccgaactcagaagtgaaacgccgtagcgccgatggtagtgtggggtctccccatgcgagagtagggaactgccaggcatcaaataaagcgaaaggccatcctgacggatggcctttttgcgttggtgcaaaaaaatgccggatgcgacgctggcgcgtcttatccagcctgctcttgcttatccgtcctgcttttgcatccactccaccacaaaatcagccagcccctcaacatcattaatatccagtaatgcgacatcaagattaagcggcacatcactggctacagcaataacatgtctgtctatcactaattcttccggtcgatgtccggctctatcgcgaaacagcacaatctttgcgatctcttcatgcttaaacccttcgaccagaatcaaatccagctttgaggtatccattcgacttgcgagaaaatgtagatccagctcttcttcgtctggtgtttccgtcatcaaggcccatcgttgctggctggcaacgatggtttgtgccgcgccagccttgcgcagctcatagctatctttgcctggcttatcaacatccatatcatggtgcgtatgcttaatcagccctggacggatccctctggcgcataatgccgggatcagttgtttcaaaagcgtagtttttccggtaccactccacgcggcaaaggcgagtaacggtatcatcgtttttcctgccatcgggcaagctcctctggcgtattcacgttaacaaatgcatctttatgatcgctgaaatcaaccgcatgaccgccagccagacgcataaatgccattacccggcgttctcctgcttgcagatattctagtaataaaggctcaatagcgcggtttaccagagcaatagtcgggtgatcgcgttcaccgtcatggacccacacgacaggcgcatctttgcgctgatgattaagccgggcggctaaatcatggggaatgtaaggcgtatcgcacggacaaaacaaaaaccactcaccagcttcctgctgcattactgaaagcatccctgccagagggcctgggtaatccgccagtgaatcttcaatcactttcagaccgcctgcctgatagatttcctgatgacgattagcattaaccacgacgtgagagagctgcgtcataagcgcgtcagcgacatgttgccataatggtttgccgtttaattcaagcaatcctttatctacgccgcccattcgtctggctttaccgcctgccagcacaacgcctgttatcgtcgtcatcagattcaccgatatcgcctcttttattgtgggattgaccctgctaacgtgtctgtctcaagagtaaggagcattactatgaaatgtaaacgtctgaatgaagttattgaactcctccagccagcctggcaaaaagagccagaccttaacctgttgcaatttttgcagaaactggcgaaagagtcaggttttgacggcgaactggcggatttgacggatgacattctgatctatcacctgaaaatgcgtgattccgcgaaagatgcggtgatcccgggtttgcagaaagattatgaagaagacttcaaaacggcgctgttacgcgctcgcggcgtaattaaagagtaaaagcttgtaagcggcgccaccaaaatcatcgtgaaatgatatccttcgtcattcgtaatgttttccggatgatgggatgaataacagcgcttttactttccagacactacacccggataccatcatggacgctctgtttgagcatgggatccgggtggattccggtcttaccccgcttaacagctatgaaaaccgtgtctatcaatttcaggacgaagatcgtcgacgttttgtcgtcaaattttatcgccctgaacgttggacagccgatcaaatcctcgaagaacatcaatttgcgttgcagctggtaaatgatgaagttccggtcgcagcacctgtggcctttaacggtcagactttattgaatcatcagggattttatttcgctgtttttccaagcgtcggtggtcgccagttcgaagctgataatatcgatcagatggaagcggttgggcgttatttagggcgtatgcaccagacggggcgcaaacagctttttatccatcgcccgaccatcggtttgaacgaatatctcattgagccacgcaagctgtttgaggacgctacactgataccttccgggttgaaagcggcattcctgaaagcgacagatgagctgattgccgccgttacagcacactggcgggaagatttcaccgttctgcggctacatggagactgccacgccgggaatattctctggcgcgatggtccaatgtttgttgatctggatgatgcacgtaatggtccagccgttcaggatttgtggatgttgctcaatggcgataaagccgagcagcggatgcaactggaaactattattgaagcttatgaagaatttagcgagttcgacaccgctgaaatcggactgattgaacctttacgcgccatgcgtttggtttattatcttgcctggctaatgcggcgttgggctgatcccgcgttcccgaaaaatttcccgtggttaaccggggaagattactggctgcgacagacggcgacttttatagaacaggcaaaagttctacaagaaccccctttgcaattaacacctatgtattaatcggagagagtagatcatgaaaaagatttggctggcgctggctggtttagttttagcgtttagcgcatcggcggcgcagtatgaagatggtaaacagtacactaccctggaaaaaccggtagctggcgcgccgcaagtgctggagtttttctctttcttctgcccgcactgctatcagtttgaagaagttctgcatatttctgataatgtgaagaaaaaactgccggaaggcgtgaagatgactaaataccacgtcaacttcatgggtggtgacctgggcaaagatctgactcaggcatgggctgtggcgatggcgctgggcgtggaagacaaagtgactgttccgctgtttgaaggcgtacagaaaacccagaccattcgttctgcttctgatatccgcgatgtatttatcaacgcaggtattaaaggtgaagagtacgacgcggcgtggaacagcttcgtggtgaaatctctggtcgctcagcaggaaaaagctgcagctgacgtgcaattgcgtggcgttccggcgatgtttgttaacggtaaatatcagctgaatccgcagggtatggataccagcaatatggatgtttttgttcagcagtatgctgatacagtgaaatatctgtccgagaaaaaataattcaatgtaaattacataaagcccgtgaatattcacgggctttttttattatttaataaatataaatacattctgataatgcatcctgccgctggacattatttcagcataagtggatattcaaagttttgctgttttatcagggaatatttatatgatacgtaagtcagctacaggtgttattgttgcgttagccgtaatctggggtggtggcacatggtacacaggtacgcaaattcagcctggtgtcggaaaatttattaaagattttaacgatgctaaaaagaaaggtgaacatgcctacgatatgacgttaagttatcaaaattttgacaaaggcttttttaattcccgttttcaaatgcaaatgacattcgataacggtgcacccgatctcaatatcaagccaggccagaaagttgtatttgatgtggatgttgagcacggtccgttgcccatcacaatgttaatgcatggtaatgtcatcccagcactggcagcggcaaaagtgaacttagtgaataatgaactgacacaaccgctatttatcgccgcgaaaaataaatcgcccgtggaagcgacattgcgattcgcgtttggtggctcattctctacgacattagatgttgcccctgcagagtatggaaagttttcttttggtgagggccagtttacttttaatggtgatggtagttcattgtctaacctggatattgaaggcaaagtcgaagatattgttctgcaattatcaccaatgaacaaagtaacggcaaaaagttttaccattgattctctggcgcgattagaagaaaagaaatttccggttggtgaaagcgagtcgaaatttaatcagattaacattatcaatcacggggaagacgttgcccaaatcgatgctttcgttgcaaaaaccatgctggatcgcgttaaagacaaagattatatcaatgtcaatctgacctacgaacttgataagttaacaaaagggaatcagcaactcggtagtggtgagtggtcattgattgctgaatctattgatccctcagcggtgcgccaatttatcatccagtataacattgcaatgcagaagcagcttgctgcacaccctgagttagcaaacgatgaagttgctctgcaagaagtgaatgctgcattgttcaaagagtatttaccgttattacaaaaaagtgagccgaccattaaacaaccggtaaaatggaagaacgcactcggcgaactaaatgccaatctggatatcagtattgccgacccagccaaatcttcatcatccacaaacaaagatattaaatcgctcaattttgatgtgaagttaccgcttaatgtcgccacagaaaccgcaaaacagcttaatttatctgaaggaatggatgcggaaaaagcgcaaaagcgggctgataaacaaatcagcgggatgatgaccttaggtcagatgtttcagttaatcacgattgacaacaataccgcctcgctgcaactgcgttatacaccgggtaaagttgtttttaacggacaggagatgagcgaagaagaatttatgtctcgtgccggacgttttgttcattaaaatactcactcgcctctgctcattcagaggcgagcaaaatttacttgtcctgccgctgtgatgacatcaacgacgtcagaagtcggtctttttcctgccacagtgagttcagccattgctgaaaatggcgcttaaagcttttgtcattgatgtagtcgccatgtaactcatcggcaataggctgtaaatccacatgtacgacaatccgcgtcagtttaccgcttaacatatcgaagaacggctgacggttattgtccggataacacagcgtaacattaagcagtttatcgaattgtttacccagtacatttagcgccatcgcaatgcctgccgcctttggtggcaacaagttttgaaaagtggagtgggtttgctgatgtttttcttgcgtgaaacgggagccttcaacgaaattgacaatggtggtgggatgcaggcgaaacttttcacaagaacgccgagtggtttcaacatctttaccacgtcgctccggatgacgtaataaataagcgcgggaataacgcttcataaacggcatatccagcgcccagcacgccaggccaagaaatggcacccaggccagctgttgcttgaggaaatatttattcatcggaatgtgcttacgaaacagcacgcacagtacgacaatatctgcccaactacggtggttacaaataagcagataccagttcttcttacttaacccttccagcccgtgaacttcccattgcaggtgtgggttcagatgcagtaataccgccagaccttcacaccagcaatacatcataaaatcacaaaaacgcgaaacctttcgccaaatgactggcacaggtagcaatagttttacaatcccggcaatgatgatcgggacggagcaaaaaatagtgaccaaaatggtcaatacgatactcagcaaaagggttatcgcagcgagtattctcgtcataatgaatttattcaaaaggttagccatagacagtgcgctaaagaagcgcaaggcgcagattttagcagaaaacgacccaaataacggatgatccttaaggagaaaaataattcatatctatccacattagaaaaaatcccattatctcaattattagggatggctttatttttaactgcatgaaaaacaaagacaaacatcatgctgtaaaaagcatgataataaattaaaagcgatgtaaataatttatgcacaaagttatccacatgacgatttgcgagcgatccagaagatctacaaaagattttcacgaaaagcggtgaaaaactcatgtttttatcctgtctgtggcatcctttacccataatctgataaacaggcacggacattatggttcagatcccccaaaatccacttatccttgtagatggttcatcttatctttatcgcgcatatcacgcgtttcccccgctgactaacagcgcaggcgagccgaccggtgcgatgtatggtgtcctcaacatgctgcgcagtctgatcatgcaatataaaccgacgcatgcagcggtggtctttgacgccaagggaaaaacctttcgtgatgaactgtttgaacattacaaatcacatcgcccgccaatgccggacgatctgcgtgcacaaatcgaacccttgcacgcgatggttaaagcgatgggactgccgctgctggcggtttctggcgtagaagcggacgacgttatcggtactctggcgcgcgaagccgaaaaagccgggcgtccggtgctgatcagcactggcgataaagatatggcgcagctggtgacgccaaatattacgcttatcaataccatgacgaataccatcctcggaccggaagaggtggtgaataagtacggcgtgccgccagaactgatcatcgatttcctggcgctgatgggtgactcctctgataacattcctggcgtaccgggcgtcggtgaaaaaaccgcgcaggcattgctgcaaggtcttggcggactggatacgctgtatgccgagccagaaaaaattgctgggttgagcttccgtggcgcgaaaacaatggcagcgaagctcgagcaaaacaaagaagttgcttatctctcataccagctggcgacgattaaaaccgacgttgaactggagctgacctgtgaacaactggaagtgcagcaaccggcagcggaagagttgttggggctgttcaaaaagtatgagttcaaacgctggactgctgatgtcgaagcgggcaaatggttacaggccaaaggggcaaaaccagccgcgaagccacaggaaaccagtgttgcagacgaagcaccagaagtgacggcaacggtgatttcttatgacaactacgtcaccatccttgatgaagaaacactgaaagcgtggattgcgaagctggaaaaagcgccggtatttgcatttgataccgaaaccgacagccttgataacatctctgctaacctggtcgggctttcttttgctatcgagccaggcgtagcggcatatattccggttgctcatgattatcttgatgcgcccgatcaaatctctcgcgagcgtgcactcgagttgctaaaaccgctgctggaagatgaaaaggcgctgaaggtcgggcaaaacctgaaatacgatcgcggtattctggcgaactacggcattgaactgcgtgggattgcgtttgataccatgctggagtcctacattctcaatagcgttgccgggcgtcacgatatggacagcctcgcggaacgttggttgaagcacaaaaccatcacttttgaagagattgctggtaaaggcaaaaatcaactgacctttaaccagattgccctcgaagaagccggacgttacgccgccgaagatgcagatgtcaccttgcagttgcatctgaaaatgtggccggatctgcaaaaacacaaagggccgttgaacgtcttcgagaatatcgaaatgccgctggtgccggtgctttcacgcattgaacgtaacggtgtgaagatcgatccgaaagtgctgcacaatcattctgaagagctcacccttcgtctggctgagctggaaaagaaagcgcatgaaattgcaggtgaggaatttaacctttcttccaccaagcagttacaaaccattctctttgaaaaacagggcattaaaccgctgaagaaaacgccgggtggcgcgccgtcaacgtcggaagaggtactggaagaactggcgctggactatccgttgccaaaagtgattctggagtatcgtggtctggcgaagctgaaatcgacctacaccgacaagctgccgctgatgatcaacccgaaaaccaggcgtgtgcatacctcttatcaccaggcagtaactgcaacgggacgtttatcgtcaaccgatcctaacctgcaaaacattccggtgcgtaacgaagaaggtcgtcgtatccgccaggcgtttattgcgccagaggattatgtgattgtctcagcggactactcgcagattgaactgcgcattatggcgcatctttcgcgtgacaaaggcttgctgaccgcattcgcggaaggaaaagatatccaccgggcaacggcggcagaagtgtttggtttgccactggaaaccgtcaccagcgagcaacgccgtagcgcgaaagcgatcaactttggtctgatttatggcatgagtgctttcggtctggcgcggcaattgaacattccacgtaaagaagcgcagaagtacatggacctttacttcgaacgctaccctggcgtgctggagtatatggaacgcacccgtgctcaggcgaaagagcagggctacgttgaaacgctggacggacgccgtctgtatctgccggatatcaaatccagcaatggtgctcgtcgtgcagcggctgaacgtgcagccattaacgcgccaatgcagggaaccgccgccgacattatcaaacgggcgatgattgccgttgatgcgtggttacaggctgagcaaccgcgtgtacgtatgatcatgcaggtacacgatgaactggtatttgaagttcataaagatgatgttgatgccgtcgcgaagcagattcatcaactgatggaaaactgtacccgtctggatgtgccgttgctggtggaagtggggagtggcgaaaactgggatcaggcgcactaagattcgcctgaacatgcccttttttcgtaagtaagcaacataagctgtcacgttttgtgatggctattagaaattcctatgcaacaactgaaaaaaaattacaaaaagtgctttctgaactgaacaaaaaagagtaaagttagtcgcgtagggtacagaggtaagatgttctatctttcagaccttttacttcacgtaatcggatttggctgaatattttagccgccccagtcagtaatgactggggcgttttttattgggcgaaagaaaagatccgtaatgcctgatgcgctatgtttatcaggccaacggtagaattgtaatctattgaatttacgggccggatacgccacatccggcacaagcattaaggcaagaaaattattcgccgtcctgcgtttcttctacaggctgcatctcgctaaaccaggtatccagtttctgccgcagcttgtccacgccttgtttcttcaacgaagaaaacgtttcaacctgcacatcaccgttaaacgccagtacagcttcacgcaccatattcaattgcgctttacgtgcgccgcttgccagtttgtccgctttggtcagcagcaccagaacggcgatattgctgtctaccgcccactcaatcatctgctgatccaaatctttcagcggatggcgaatatccattagcaccaccagaccttgcaggctctgacgtttttcgaggtattcgccgagcgcacgctgccatttgcgcttcatctcttccgggacttccgcataaccgtacccaggcaagtcaaccagacgcttgccgtcagccacttcaaacaggttgataagctgggtgcgccctggggtttttgaggtacgagccaggcttttctggttagtcagcgtgttcagcgcgctggatttacctgcgttggaacggcctgcaaaagccacttcaattccggtatcggaaggtaggtggcgaatatcaggcgcactcatcacaaaatgcgtctgttgataattcaaattagtcaaagcggtcgtctccgtcagtcaaagctttgtggcgattatacctgaaccataataaaaggcggatttttcggcgtgagcgttgtaagtaaaagccatacgctttgtgagacattgccgatagtctttatgcgaaatagcagagaaaattctgcgatgcatgtcaaataagctatataaatcagtgaattgcttttatataaaactctgaaaatgtgcaaatactgatggcggttgattgtttgtttaaagcaaaggcgtaaagtagcacccatagagcgaggacgctaacaggaacaatgactcaggatgagggtcaggagcgccaggaggcgaagacagaggattgtcaggaagacaaacgtccggagacgtaattaaacggaaatggaatcaacacggattgttctggctaatggaaaaacagggtgtgttggcggcctgcaaggattgtaagacccgttaagggttatgagtcaggaaaaaaggcgacagagtaatctgtcgccttttttctttgcttgctttctgttagattccgccgcaaatctatactgaataaaacggctaaaagacgaaccattatgaaaccatcttcaccatcacgcagcaaaggtcatgcaaaagcgcgtcgcaaaacgcgcgaagagctgaatcaggaagctcgtgaccgcaagcgtcagaaaaaacgtcgtggtcatgcgccgggcagccgcgcagcgggcggtaacaccacgtcaggcagcaaaggccagaacgcaccaaaagatccacgtattggcagtaaaacccctattccattgggcgtgactgaaaaagtcaccaaacagcacaaaccgaagagtgagaaacctatgctttcaccgcaggcggagttggaattactggaaacggatgagcgtctggatgcgctgctggaacgtctggaagcaggcgaaaccctgagtgccgaagagcaatcctgggtggatgctaaactggatcgtattgatgagttgatgcagaaactcggcctctcttatgacgatgacgaagaagaggaagaagacgagaagcaagaagacatgatgcgtctgctgcggggcaactaacggattgccgccatgggccttcccgttctgctgataacccttccggttatatgttatctggtgtggttattcgttaaactacagcggttgtcgcggcgacaaaagtggctgcgcaaccggctgatgacccgaaacgggcatccgccggtacgccgtagccgccagagacgccatcggaaggagtgagcatgtctgtacagcaaatcgactgggatctggccctgatccagaaatataactattccgggccacgatacacctcgtacccgaccgcgctggagttttcagaagacttcggcgaacaggcgtttttacaagccgtggcgcgctatcctgagcgtccattatctctctacgtacatatcccgttctgccataaactttgttacttctgcggttgcaataagattgttactcgccagcagcacaaggccgatcagtatctggacgcgctggagcaagaaatcgtccatcgtgcaccgctgttcgccgggcgtcacgtcagccaattgcactggggcggcggaacgccgacgtatctgaataaagcgcaaatcagccgcctgatgaagctgctgcgcgaaaacttccagttcaatgccgatgcggagatttcgatcgaagtcgatccgcgggaaatcgaactggatgtactcgatcatttacgcgccgaaggctttaatcgcctgagcatgggcgtgcaggacttcaacaaagaagtgcaacgtctggttaaccgcgagcaggatgaagagttcatctttgcactgcttaaccatgcgcgtgagattggttttacctccaccaacatcgacctgatttacggcctgccgaaacagacgccggagagtttcgcctttaccctgaaacgtgtggcggagctgaaccccgatcgtctgagtgtctttaactacgcgcatctgccgaccatttttgctgctcagcgcaaaatcaaagatgctgacctgccgagtccgcagcaaaaactcgatatcctgcaggaaaccatcgccttcctgacgcaatcgggctatcagtttatcggtatggatcactttgcccgtccggatgacgagctggcggtggcccagcgtgaaggcgtgctgcatcgtaacttccagggctacaccactcagggcgataccgatctgctggggatgggcgtttccgccatcagcatgattggcgactgctacgcgcagaaccagaaagagttgaagcagtactatcagcaagtggatgaacaaggcaatgcgctgtggcgtggtattgcgctaacgcgtgatgactgtattcgccgcgatgtgattaagtcgctcatctgcaacttccgtctggattacgcccctattgagaaacagtgggatttgcacttcgctgattactttgcggaagatctcaagctgctcgccccgttagcaaaagatgggctggtggatgtggatgagaagggaatacaggtgacggcgaaaggtcgcttgctgatccgcaacatttgcatgtgctttgatacctatctgcgccagaaagcgcggatgcagcagttctcacgggtgatttaaatagtgaatggcgcttcgtttacaaagtagaaaacgaaagcgccatcaatgtgctgagaacaagattgcctgatgcgctacgcttatcaggcctacaaaacctgttgaaaatattgcttttgtaggccggataaggcgttcacgccgcatccggcatgaacaaagagcacttcatcagcaatctgaaactcaactaaacagcccaatcattgcggcacacagcacggcagcaacggcagtttgcggtgtgtggctgtcaactgcgccactcgataccagattaattattgattccagcataatgactctccccgttttccgggcaagatcatactgaacttatcggaacagtaaagcgtaaaataccagcaatttgcgctcaataatcaatctttacacacaagctgtgaatcactccatccccagctcttttaacttacgcgtcagggtgttgcggccccagccgagtagccgcgccgcttcctgtttatgcccctgcgtatgtcgcaacgcggtcgtcagtaacgtccgctccagctctggctgcgcttcggaaagcagattttgatgaccggaacgcagcgctctgtctgcccactgcgcaagaagcgtcgcccaactgtccggttgcatttgcgaagtactctccgcaaccgttgattcaaacagttcgccgggcaaatcctgaatcaacacttcctgcccggcggccatcaccgttagccagcggcaggtgttttccagctggcgcacgttgcctggccacgccagacgcgtcagagcagcttcggtttccggatgcagtaacttcgcttctacgcccagttcgtgcgcggcaacctgtaaaaaatggcgcgccagacggggaatatcttcccgacgttcgcgcagcggcggcagatgaacgcggataacgttcaggcggtggaacagatcctcacggaacttaccttcctgcactcgctgttcgagattctggtgagtggcagcgataatccgcacatccactttcaccggcgcatagccgccaacgcggtaaaactgaccgtctgccagcacgcgcagcaaacgcgtctgcacatccagcggcatatcaccaatttcgtcgaggaataatgtaccgccatcggcctgttcaaaacgcccctgacgaatggtattcgcgccagtaaacgcgcctttctcgtggccaaacagttctgattcgatcaaatcttttgggatagctgccatattcagcgcgataaacggcgctttggcgcgcggactgtggcgatgcagggcatgagcgaccagttctttaccggtgccggattcgccgttaatcagcacgctaatagaagaacgcgaaagccgaccgataatacggaacacgtcctgcatggctggcgcttcgccgatgatatcggtcgttgggccgttaagctgaatattacgcggctgctgctgttcctggtaatgactgatagcgcgctcaaccagcgccactgcttcgtcgatatcaaacggtttgggcagataatcaaacgccccttgttgataggcgctgacggcagcatccagatcggaatgtgcggtcataatgatgaccggaagcattggatggcgctgtttaatctgcttgagcagcgccagcccgtccattcccggcatacggatatctgaaagcagcacatccggcgttttgctcgccagcgcctccagtacttccgcgccgttctcaaatgtcgtacaggttaaacccgctccagcgagcgcacgttcaagcacccaacggatggaactatcgtcatcgactacccagactatccctcgttgcataaacgtcacctttatttcctgataggcaggtaaaccgagaactcggtatgccctggccaactggtaaattcaattttgcctgaatgctgatcaatcaaattacgagcgatggataagccaagcccggtgccaccttcgcggccgctgaccatcgggtaaaacagcgtatcctgcaaatgaggcggaatgcccggcccgttatcttccacatcaatccgcgccgccagccggtagcgctcgccgtgtaaggtcagttgaaacgcggtgcgggtacgcagaatgatttcaccgccttccggccccagcgcctgtagcgcattgcgcacaatattcagcaagacctgttcaatttgatccgggtcgtgcgccagttccggcaggctgggatcgtaatcacgaatcaaccgcacgttgtccggcagttccatcgacaccagcgttaccacgcgttcagccactttgtgaatactttcggtaacgcgcgtaccgggcagctgcggccccaacagacggtcgaccagatttcgcagccggtccgcctgttcgataatcactttggtatattcgagtagtgatgggtcaggtaacgctttgctgagcagctgcgccgcgccacgtaaaccgccaagcggatttttaatctcatgtgccaggccgcgcactaaatcacgggcagcaacctgctgggcgtgctgtagctgttcctgacttaagcggcgctggttatccatcggagccatctccagcaggatcatgccgtccggcatacgctgggccgtcacagaaaggatatgcgagcgcccgtcgatgaccagcgtcacttcgttatcggtaaaaccttgccccgcctccagactttcttgcatcagctcgatatttaatgagaagtagctcaacagttccggtaacggtgtaccaaacaatttgcgggagctttgggcgagcagttgttgcgcggcggggttggcgtaatggatcgccaggttgtcatcgattaacaaaatactgttaatcagcgagttgaggatctgcccagcatcgggctgcgtgcctgttgccataaagcagtctcctgaacaggttgcaccattttagtgcattatagctttttacggataaaaagcgcgaagcatcagagaattgacggagaaaaaagcccatgcagagatgggctacagatagctgacaaacttcacgttggagagcgactcacctgctccggcctaccacatcatcaccgtgtaggccgggtaagacgcatttgcgtcgcatccggcgtgatgtgcttgccaccgatcccaggcctgccagagacaggcgaaaagtttccacggcaactaaaacacttagacgctgtagtacagctcaaactctaccggatgcggagtcatacgcacgcggtcatcttcttcgcgacgcagtgcgatgtacgcatcaattgcttcgtcagtgaacacgccaccggctttcaggaactcgcggtccagatccagttcgttcagtgcttcttccagagagcctgcaacctgtgggatctctttcgcttcttctggcggcaggtcatacaggtttttgtccatggcttcgcccggatggatcttgttcttgataccatcaagaccggccatcagcagggcagcaaagcacaggtacgggttagctgccggatccgggaaacgtacttcgatacgacgtgctttcggagaagaaaccaccggaatacggatagacgcagaacggttacgcgcagagtaagccagcattaccggtgcttcatagcccgggaccagacgcttataagagttggtggtcgggtttgccagggcgttaatcgctttagcgtgtttgattacgccgccaatgtagtacagcgcctgctcagacagacctgcgtatttgtcgcctgcgaacaggttaacgccgtttttagacagagacatgtggcagtgcataccggagccgttatcaccgaacatcggttttggcataaaggtcgcggttttaccgaagcggtgcgctacgttgtgcacaacatatttgtagatctgaatttcgtcagcttttttggtcatggtattgaagcgggtagccacttcgttctgaccagcagtcgctacttcgtggtgatgggcttcaaccaccaggcccatctgttccatcaccagacacatttcagaacgaatatcctgagcagagtctaccggcggaaccgggaagtaaccgcctttcactgccggacggtgacctttgttaccaccttcatattgggtggaggagttccatgcgccttcgatatcgtcgatagcaacgtgagaaccggagatagatgatccgaaacggatgtcatcgaacaggaagaattcaggttctggcccgaacagtacggtgtcggcaatgccagtggaacgcaggtaatcttcggcgcgcttcgcaatggagcgcgggtcacggtcatagccttgcagggtgccaggttcaaggatgtcgcaacggataatcagggtggagtcggcgaagaacgggtcaatcactgcggtggatgcgtctggcatcagcaccatgtcggactcgttaatgcctttccagccgccaatcgaggagccgtcaaacattttgccttcttcgaagaattcagcattcacctgatgagcagggatagtgacgtgctgttctttacctttagtatcggtgaagcgcaaatcaacaaacttcacttcgtgctcgttcagcatcgtcagtacgtgttcagcggacatactttaactctcctggattggtcatggtcgtcgtggtaacgaaatctgcaattattttggccgtgtcgccgtaaaaaagataaagcgaaatctgtgccaacttttaaattgcccctaaaaggcgttatcatgcgcaccatcgtgcaaaagggctgcaccacgatgtgaatgttgcaccaatatagtgcttcaatggaaacattaagcaccatgttggtgcaatgacctttggataaccctttttatgctccgtgaaagcgatcacaaagggactctgcaatacttgtttgcggaggatgtttgtgatcctgttttgtagtgcgattaatccgtgtacaataacgcgctatttctaatgcctgaggcaaagttgtgatcgaaaaattgcgtaatatcgccatcatcgcgcacgtagaccatggtaaaaccaccctggtagacaagctgctccaacaatccggtacgttcgactctcgtgccgaaacccaagagcgcgtgatggactccaacgatttggagaaagagcgtgggattaccatcctcgcgaaaaacaccgctatcaaatggaatgattaccgtatcaacatcgttgataccccggggcacgccgacttcggtggtgaagttgaacgtgtaatgtccatggtagactcagtgctgctggtggttgacgcatttgacggcccgatgccgcaaacgcgcttcgtaaccaaaaaagcgtttgcttacggcctgaagccgattgttgttatcaacaaagttgaccgccctggcgcgcgtcctgattgggttgtggatcaggtattcgatctgttcgttaacctcgacgcgaccgacgagcagctggacttcccgatcgtttacgcttctgcgctgaacggtatcgcgggtctggaccacgaagatatggcggaagacatgaccccgctgtatcaggcgattgttgatcacgttcctgcgccggacgttgaccttgacggtccgttccagatgcagatttctcagctcgattacaacagctatgttggcgttatcggcattggccgcatcaagcgcggtaaagtgaagccgaaccagcaggtcactatcatcgatagcgaaggcaaaacccgcaacgcgaaagtcggtaaagtgctgggccacctcggtctggaacgtatcgaaaccgatctggcggaagctggcgatatcgttgcgatcacgggccttggcgaactgaacatttctgacaccgtttgcgacacgcaaaacgttgaagcgctgccggcactctccgttgatgagccgaccgtttctatgttcttctgcgttaacacctcgccgttctgcggtaaagaaggtaagttcgtaacgtctcgtcagatcctggatcgtctgaacaaagaactggtacacaacgttgcgctgcgcgtagaagaaaccgaagacgccgatgcgttccgcgtttctggtcgtggcgaactgcacctgtctgttctgatcgaaaacatgcgtcgtgaaggtttcgaactggcggtatcccgtccgaaagttatcttccgtgaaatcgacggtcgtaaacaagagccgtatgaaaacgtgactctggacgttgaagaacagcatcagggttctgtaatgcaggcgctgggcgaacgtaaaggcgacctgaaaaacatgaatccagacggtaaaggccgcgtacgtctcgactacgtgatcccaagccgtggtctgattggcttccgttctgagttcatgaccatgacttccggtactggtctgctgtactccaccttcagccactacgacgacgtacgtccgggtgaagtgggtcagcgtcagaacggcgtactgatctctaacggtcagggtaaagcggtcgcgttcgcgctgttcggtctgcaggatcgcggtaagctgttcctcggtcacggtgcagaagtttacgaaggtcagattatcggtattcatagccgctctaacgacctgactgtaaactgcctgaccggtaagaaactgaccaacatgcgtgcttccggtactgacgaagccgttgttctggttccgcctatccgcatgactctggaacaagctctggagttcatcgatgatgacgaactggtagaagtgaccccgacctctatccgtattcgtaaacgtcacctgacggaaaacgatcgtcgtcgcgccaaccgcgcaccgaaagacgattaatttcgttttttagtcataaaaaacctgccagcgatggcaggtttttttttgcctgtcgtgagcactcagcaatgcgagtatctcccttataagtctgtggttacgtcaatagagagctttgtcacaattatctgcaaagtcatacgccgttaattgctttcttttttggcgtaagcgtaagatgcctcatctggtttaaaccaaaaggattaaacaatgacgggaaatcaatccaccgtagaaaatgcaaaagagaaactggatcggtggttaaaagatggcatcactacgccgggtggaaaactcccttcagaaagagagctgggagagctgctgggcattaaacgtatgacgctgcgccaggcgttgctgaacctcgaggcagaatccaaaatcttccgtaaggatcgtaaagggtggttcgtgactcagccgcgatttaattacagcccggagctgtcggcgagctttcagcgggccgcaattgagcaagggcgggaaccttcctgggggtttaccgagaaaagccgtaccagcgatattcccgagacgctcgcgccactgattgcagtgacgccatcaactgaactctatcgcatcaccggctggggggcgttggaaggacataaagttttctatcacgaaacatatattaatcctgaagttgctccgggttttattgaacaacttgaaaaccactcattttctgcagtctgggaaaagtgctaccaaaaagagacggtagtaaaaaaattgattttcaaacccgtcagaatgccgggcgatatcagcaagtatcttggcggttctgcgggtatgccagcgatcttaattgaaaagcatcgcgccgaccagcaaggcaatattgtccagatagatattgaatattggcgatttgaggccgtagacctcatcattaatctgtaggtgttttatggtgacaataaataacgcaagaaagattctacaacgtgtcgatactcttcctctttatttacatgcctatgcctttcatttaaatatgcggctggaaagagtattgcctgctgatttacttgatatcgcgagtgaaaataatctgcggggcgtcaaaattcatgttctggatggagagcgtttttctcttggtaatatggacgataaagaactctctgcctttggtgataaagcccgccgtctgaaccttgatattcatattgaaaccagcgcctcagataaggcatctattgacgaagccgtcgccatcgcgttgaaaactggggcatcgtccgtacgtttttatccacgttatgaaggtaatttgcgcgacgtattatcgatcatcgctaacgacattgcctatgtacgggaaacgtatcaggacagcggcctgacttttacgatcgagcagcatgaagatttaaaaagccatgagctggtgtcgttggtcaaagaaagtgagatggagtctctttccttactgtttgattttgcgaacatgatcaatgcaaatgagcatcccatcgacgctttaaaaacgatggcgccgcatattacccaggtgcatatcaaagatgcattgattgttaaagaacagggtggtctgggccataaagcctgtatttcaggtcagggagatatgcccttcaaagcgttattaacgcaccttatctgcctgggcgatgatgagccgcaggtgacggcatatggcctggaagaagaggttgattattatgctccggcgttccgctttgaagacgaagatgataatccgtggatcccttatcgccagatgagtgaaacaccactaccagaaaatcatttactggatgcgcggttacgtaaagaaaaagaagatgcgattaatcagataaatcatgtgcgtaacgtactacaacaaatcaaacaagaggcaagccatcttctgaaccactaataagttttaactcatacgcagttaataaaaccattccataagaatggtcgatatcttattgcctttaaaacagtgattttataaatcgcttaggggatgttatgctcacgaaaaagaaatgggccttatttagtctattaacactgtgtggcggtacaatttataaattaccgtcgctgaaagatgcgttttatatcccgatgcaggaatatttccatttgaccaatggtcaaattggtaatgctatgtcggtaaactcatttgtcacgacagtgggtttttttctgtctatttattttgccgataaactaccgcgcagatacaccatgtcattctcactcattgcgacaggattactgggtgtttatttgacgacaatgccggggtattggggcatcctctttgtctgggcgctatttggcgttacttgcgacatgatgaactggccggtcttgctcaagtcggtaagtcgattgggcaatagcgaacaacaaggtcggttgtttggcttcttcgaaacagggcgtggcattgtcgataccgtggtggcattttctgcgttggcagtatttacctggtttggcagtggcttattgggttttaaagcaggcatctggttctattcccttattgtgattgccgtaggcattatcattttctttgttctgaatgacaaagaagaggcaccgtccgtcgaggtgaaaaaagaagacggagcatcgaaaaacaccagtatgacctcggtgctgaaagacaaaactatctggcttatcgcttttaacgtcttcttcgtttacgcggtttactgtggcctgacattcttcattccattcctgaaaaacatctatctattgcccgttgcgctggtgggggcttacggcatcattaaccaatactgtctgaaaatgattggtggaccgattggtggcatgatttcagataagatcctgaaatcgccgagtaaatatctatgctacacctttatcatcagtaccgctgcgctcgtactgttgattatgctgccgcacgaaagtatgccggtctatttagggatggcatgtacgctgggctttggcgcgatagtctttacacagcgagccgtattttttgcacctatcggcgaagcaaaaattgctgaaaataaaacaggcgcggcgatggcgttgggtagctttattggttacgccccggcgatgttctgcttcagtctgtatggctacattctggatttaaatccggggattattggctacaaaatcgtgtttggcattatggcctgcttcgcattctgtggtgcggtggtttccgtaatgctggttaagcgtattagccaacgtaagaaagagatgctggcggctgaagcttaattaatggccggatgtgcttaatccggccaacgaaaaccgtatcaaccgtaggccgcatccggcaaaataaaatccgctgaatccccagcggatttttcgaagtttcaatttcaggaaacttcctgctcggcaaccaccagttcaacattctcttcacttaacaactggcagaaagaattgggaggcggggcatctgtaaaaaaagccctgacattccgtgcattgccaattgaaacggcagcagacgcggcaaacttcgtatgatcggccactaacaatgtattccgcgcatgtttaatcatcgttctcgcgactaacgcttcatttacatcaaattccagtagggtgccgtcatgttcaatggcacctatactggtgattaaataatctgcgcggaagccttcaataaaatccacggctcctgggccgataatcccgccgttatgagcgcgtaaagtgcctcccggcaccatcacttcaatatcctgattcttataaagaatctgtgccacacgtaggctgttagtgataatgcgtaaatcacgccggttgagtaatgccctggcaacggcttctacggttgtaccgatggtgataaagacggtacagcgttcgggaaggtaatcggcgactgcctcagcgatcgcccgtttctcggcggtgagcgaaagttcccgttgctcaaaagcggtattcatgacgctggagacgcgcccggcccctccatgatgacgggtgatcaagccctgctcactgagttttcggatatcccggcgcacggtttgcgttgaaacatccagcagttgtgccagttcttcaatattcatataaccgcgttctgcgattagatgaacgagttggtcatggcgtggattacctgtcacttcgatgatactcatgaatactcccttgcccctcctcggtagatgtttaccattttacgcataaagtgacaaaaatgattcggtttgctcacgattaggaatgccggcccgaccgccaggctgggtacatttcatcgcggcaaccgcactggcaaaacgaatagcctcttttgttggcattttttctgccaacgctaccgcgagtgcgccgtgaaaaacatcgcctgctccagtggtatcaaccacattgacagaaaatgcctcctgttgacacaaatgaccatcttcaatccacaacgatccttcagaacccagcgtaacatacactttacctgctgtttgtgtcgttgcctggaacaaaccttcttcaggtgactgcaggccagtcatgcgtttcagccctggtgttgagaacacggcgtgatcggcaagcgcgacaagtggagaaatatcctgcggtgtcatatcggcgtctaaaagcgttgtcacacccgcaagacgcgctagcgagaatgctttttcagtaccgctatgccagcgaacatcggccagaatcagatcataacgagagaaatcgatcgcttctaaccattcggcatcagtaccgagatcgggacttggataattaacgataatccgttcgccatgctgatcaacgaggatcgctgattgcgatgaacgggcgttaggatatcggcggcaaaatgcggtattgacgccccaaccctcaagttctgcaagtaaggtatttccacaactgtcatcgccgacgcgaccgatgaaatcaacctccacgccaagctttgcgattgcaacagcggctgttgctgccgggccgccaccaatctcaagataatgatttgcctgatattttccgccgccatccggcagagtgagcaaagaataaatcctgtcctgaactgtgatacccacgcatgcaattttggtcatatttgtcttgtcctgtttaattttgtcgtcttcggtcaatttaaatgacacaaatgatcaaattagtgatgcgtgtcgtgtttttgaacataaattacaaatatgctcaaaaacagacgaaaacgaattttcaattgtcattattttgtcaatgtcagacaggagagtattcatggcaaccattgcatttctcgggctggggcagatgggtagcccaatggctaacaatctattgcaaaaagggcattcattgcaggtatttgatgtcaatgcacaggccgtcgatgcgctagttacgcagggggccactgcggcacaaaccccagcggaagcggcagcaggcgctgaatttatcatcactatgcttcccaatggtgacattgttcgacaggttctgttgggggaaaaaggcgtctgtgaggctgtttcatctgacgcgttattgattgatatgtcgactattcatcccttacagaccgatgcattaatacgggagttacaagaaaaaggcatcagtatgatggacgcccccgtgggcagaacgtccgtgaatgcgattgatggcacattgctgattttagcgggtggcactgatgagcagattgcacgtgcacgcccgattctcatgtgcatgggtaatgagctggtcgaggctggcggcccaggaatggggatccgcgtgaagctaattaacaactatatgagcattgcgcttaatgcgctgtcctccgaggccgctgtgttatgtgagtcactgggattaaatcttgatgtcgcaattaaggtgatgagtggtacggcagcagggaaaggacattttacgaccacctggccttgcaaagtgctgaaaggcgatctttcacccgccttcatggtggatctggcgttgaaagatctgcgtattgcagttgacgtcgctcgggagacgggggcaccgctcaatatggggattgcagcagaaagttattacgctgcagcaagtcaagacggcaaagggcggcaggactggagtgccctgctaaatcaggttcgccagcaggctggtctttaattttatctattaacaggagtttctatgtcatcccacttcaccccatttacgctgaaagatatctcccgcccaggtggtggatttgccatgttagctgtcgatcagcgtgaggccatgcgcttgatgtttgcggcagcagggcagccaaaacccatcgccgacagtgtactcaccgattttaaagttgccgcgacccgaatcctttctccttatgcttctgccgttctggcggataaacaattttgtcttgagcaaatagtcgagcagggcgctgttgctaattcttgcggcctgattgtcgctgccgatctttttatcccaggtaatggcatcccggttgatagcgttgaaatagatatgtccgtcgacccgcataaagcccgtgaaatgggggctaaggcaatgaaattacttgtactctggcgtgaagatgaacccgcagaggaacgtctggcaatggttgataaatttgttcgtcgctgccgtagtgccgggctggttagcattattgaacctgtggtgcgtccacctcgtcgcggttgggactttgatcgtgaaagcgccattgttgccgccgccgcagagcttggtggaacagaggctgatctttacaaagccgagatgccattagggggcaaaggcgatgaaaaaaccttacttgccgcctgtcagcaacttaacgatcagatgaagatgccgtgggtaattctttcttctggcgttgatgccgatatttttggccgtgcagtaagtattgccatgaaaggtggtgcgtcaggcttcctggctggacgagcggtttgggcgtcggttgttggtgcacaagatccacaaactatgctgcgagatgtctctgttcctcgtttacaacggttggcagaaattgtcgatgaaggtatcgcgcaacgctaatcccctatggatatcgattctggagaataacaatggataaaattacccaggttttattttcagatattgggaaagtcaccactcaatatgttgaagtaccacaccaggaacttaaaccgcacgaagtgcggattgcgcctgtgttctatgggatatgcggttcggatctgcatgttctgaaaggcggtcatccgtttgctaaaccacctgtcgtccccggtcatgaaattgcagcgcgcgttacggaagttggcagcgacgttaaaaatgtacagccgggcgatcatgttgtggtcgatcccatcatggcttgcatggaatgccgagcctgcaaagcaggacgttttaatctttgtgaaccaccgcaggttgctggttttcgcgcaccgggctttgctcgctcacaacacattgttcctgcgcgtaattgccatgtcgcaccagcctctttaccgctaaaagtgttggcctttgccgaaccggcggcttgtgcccgtcactgcgttaaccgaatgccgaaagcttctctggaaagcgtactggtgattggtgccggaacgataggcttatccatcgtgcaggcactgcgcattatgggggcaggtaagattaccgtgattgaacctgacgctgccaaacgcgcgctggcgttaaagctgggcgcagcagaagtttgggcaccaggtgagctggccgcagatgtgcgatttacgggggcgattgatgtcgttgcagcgcaggccacgcttaacgatgcatgtacccgtgtatatgccggaggcaccgtcgtgtgcatgggcgtaccaagtgggccgcgtgaaataccattaccgatgatgcaacgtttcgagcgtgacttgctcaactctggcatgtacatccctgaagatttcgatgctgttatcgaatggctggcggatgggcggtttgataccagtgaactgattaccgatttatttgccattgaggatgcagcggcggcattcgaacgcgcgcagcaaaatgactccataaaggtcatgctgcaatttgcgccggaatgattttctaaatctctgtctggcgctgcgtcacgtcagcgccaccctacaacaattaaaaaggacactgcgatgagtcaaatcaccagtcctgcaacttattcaattagtcggccacaggacgtaattgatattgttaataagaactctgcaatcaacaccagtatcggcgttatttttattgctttgggcggcatattgattgatgcctaccaggcggcgatggtggggtttggtaataaatacattgccgctcaatttggcatttctccaggccttgccgcaaccgttaatgcgtcagtattaatcgccgcgttaattggcggtttattagcgaaccgagtaataaaccgctttgggcaaaagcgagcatttattattggcatggggctgtgcaccatcggggctgctgcggtagctattgcgcccagtatctggtgggtgctggtgtgccgcgtcatcatgggctttggtttaggcatcgacttccctttggcaaccaatgccgtggcagagcttcgtggttcaacgtcgaagaaaaccggaacgtcggtcaacctctggcaaatggcctggtatgtttcgacaactgttgtttatttggtgctcttgccgctgcttctgtcgggtatcgctgaagaacaattgtggcgttacggaatattcatcggagctatttttgcagtcatcttcatgattttgcgttacttctttattggtgaatccgcaatgtgggccgcacgcgtcgggcgttaccaggaagcgtgcgacattctgggaaaacgttatggtgttcaggctcgcgttgcggcatcgagtacaacagaagcgaaattctcggaaaaagcagagaataaatacagtggtggatatggcatcttatttaatgatcgttaccgcaaacgcaccattcttggctgtgtcgtggcaaccatgcaggcgtggcaatataacgccgtaggtgtttatcttcctcttacgttggcgggaataataagtggcgggcttactggtgcgttgacgggttctgccgtcgtgaatgccctttgtggggtgacaggcgggatgatcggctcgtttattctccaacgactgggtactcgccgacagtcgatgtatggatttgctgttgtgaccttagcattgctgtcgttaggcgcactggcaacgactaatccatggctgtctttagggttattgggatcaattattttcttccattcagcgggtcctggtgggctgggcatgaccattgccacactctcttatcctcccgctattcgccctactggggtcggatttgcccgcgctattatgcgcacaggggcaattgcaggactcattttctggccgatgctgtggggggcgttgaaaactgaagcgttttactggttggcaatcgtgccattcttggggttcctgacctgcgtattgattaattgggaaccactgggtgcaaatgttgatgctgaggatgcagaggttctggctgaattgaagaaataaattaatgcgcatcggcttaaaccgatgcgcattaattcaaactgcccacgtttagtggttcgtatcccagatttctcgcctaccaggagaggaaaattatgtctgaaaagttacccgcaccgcgtgaagggctttccggtaaagccatgagacgtgtcgttatgggcagtttcgcaggcgcgttaatggaatggtatgacttctttatttttggcacggcagcaggactggtatttgcaccgctgttttatccagacagcgatccttttataggtcttatagccgcctttgctacctttggcgttggttttttgacccgtcctttaggtggtatcgtctttggccattttggcgataaaattgggcgaaaaataacacttatctggacactggctattgtcggttgctccacatttttgattggttttattccgacgtatcaggaaattgggatctgggcaccgctcatattaatggcgctgcgtttaattcagggctttggtcttggtggcgagtatggcggagcggcattgatgaccatagaatcagcgcccgaatcccgacgcggatttttaggttcactcccgcaaacggctgcgtctgtgggtattatgctggcaaccggtatttttgctctctgtaaccattttcttacttcggagcagtttctctcctggggatggcgcattccgttttggctttctgcggtgatgttgatcgttgggctgtttatccgcctgcataccgaagaaacgctggattttcaaaagcaaaaaacgacgaataataaagaaaagtccgttcctccgttgattgaattattcaaaaaacatccacgaaatattttattggcactgggtgcgaggctggcggaaagtgtctcctctaatattattaacgcctttggtattgtctatatttccagccaattagcattgtcgcgagatattcccctgacgggtatgttgattgcctcggcgatcggtattttcagttgtccattggttggatggttatcagatcgtataggtcaaaaaagtctgtatttgtcgggagcaggattttgtgtcctgttcgcgtttcctttcttcttattactggatagcaaaagtacgctcatcatctggtgcagtatgatcctcggctacaacttaggtccgacgatgatgtttgccgtgcagccaacacttttcacccgcatgttcggtaccaaagtacgatataccggcctttcttttgcttatcaattttccgcgattcttggcggactaagcccccttatcgcctcaagtttgctggcgctagggggaggaaaaccgtggtatgtcgctctgtttttatttgctgtctcagttctttcctttgtttgcgtctggctgattgagccgaccgatgaacaagaaaccgcttcttaccgctacatcagggaacaatctcatgaaaactgaacgaaaaaacgagcattacctggcgctacaacaggcgtttgacgcgccatggcctgggcctgtaggagagttagtgacgctggaaaaaggcaatattcacctgcagatttatccgcatgatggtgccaggataacctcgttaaaggcatttggttctgaagtattacgccaatggcagccgcagcgcagagcttttcagtatggctgtttcccaatggtgccgtgggcagggcgactggggaatgcgacgctgaatgctggtgggcaatgttattctttacccgccaataaaccaccacatgcgttgcatggtatggcttgttactcaacgtgggaaatcatcgacaaaacagcagattccctgactttacgtatgcccccggcttcaccgtggccctggcaaggggaagtgattcagacttttttgctggagaacgatgcgctggttttgcaactggaagtccattcatatgccgatacattcccggcctccgcaggctggcatccgtggtttgcgaaaaagctgactccgcaaaatacagaatcgttgcaggtgctttttgatgcggactggcaagaagaagcgggtagtgatgaactgccaactggaaatcgtatctctcctcaagccggtccctgggatgactgttttggtttttatgacggggtgaaggttaagttactgtggcctggtaaactcgcgatgaccatgatctcttctgcaaacagtctggtggtatttgataaacagcccgatgccacctgtattaacccgctgactcaggcacctaacgcaataaatctaacgccggaattggtgacaccagataggccgctggtcatcgaaactcgttggcaatttacacctgaatcttaaccattcatctattgcgaaaaagccagtgaaattactctgctttttcgcaatcagcatcacaagattacccttattgccacatagccaaacccatcctttcccgctacagttaatttcttgtggcgcgaaaggaggcaaaaatgctctatatctttgatttaggtaatgtgattgtcgatatcgactttaaccgtgtgctgggagcctggagcgatttaacgcgtattccgctggcatcgcttaagaagagttttcatatgggggaggcgtttcatcagcatgagcgtggggaaattagcgacgaagcgttcgcagaggcgctgtgtcatgagatggctctaccgctaagctacgagcagttctctcacggctggcaggcggtgtttgttgcgctgcgcccggaagtgatcgccatcatgcataaactgcgtgagcaggggcatcgcgtggtggtgctttccaataccaaccgcctgcataccaccttctggccggaagaatacccggaaattcgtgatgctgctgaccatatctatctgtcgcaagatctggggatgcgcaaacctgaagctcgaatttaccagcatgttttgcaggcggaaggtttttcacccagcgatacggtctttttcgacgataacgccgataatatagaaggagctaatcagctaggcattaccagtattctggtgaaagataaaaccaccatcccggactatttcgcgaaggtgttatgctaaaaaccattcaggacaaagccaggcaccgtacccgtccactatgggcctggctaaaactactctggcaacgtattgatgaggacaacatgacaaccctggcaggtaaccttgcctatgtgtcgttgctctcattagtgccgctggttgccgttgtttttgcgcttttcgccgcttttcccatgttttccgacgtcagcattcagttgcgtcactttatttttgccaactttctgcctgctactggcgatgttattcagcggtatatcgaacaatttgttgccaattccaacaagatgaccgccgttggcgcgtgcgggctgatcgtcaccgcgttattgttgatgtactccatcgatagcgcgttgaataccatctggcgcagtaaacgagcgcgaccaaaaatttactcgtttgccgtgtactggatgattttaacgctggggccgctgctggcaggggctagtctggcgatcagttcctatttgctctccctgcgctgggcgagcgatctcaatactgtcatcgacaacgtgctgcgtatttttccgctgctgttgtcgtggatctccttctggttgctgtacagcattgttcctaccatccgcgtacctaaccgcgacgcgattgtcggcgcgtttgttgctgcactcctgttcgaagcaggaaagaaaggtttcgcgctttatatcaccatgttcccgtcatatcagctcatttacggtgtgctggcggtgatccccattctctttgtctgggtctactggacatggtgtatcgtcttgcttggcgcggaaattactgtcactctcggggaataccgcaaactaaaacaagctgctgaacaagaagaagacgacgaaccatgattgcattaattcaacgcgtaacccgtgccagcgtcaccgtggagggagaagtgacgggcgaaattggcgcgggacttttggtgttattgggtgtcgaaaaggatgacgacgaacagaaagcaaaccgtctgtgcgagcgtgtgctcggctaccgcatctttagcgatgccgaaggcaagatgaatctcaacgtgcaacaggcgggcggcagtgtgctggtggtttcccagtttaccctcgccgcagataccgaacgggggatgcgcccaagtttctccaaaggtgcatcaccggatcgcgcagaggcgttatatgactatttcgtcgaacgctgccgtcagcaagagatgaacacgcaaacaggacgcttcgctgcggatatgcaggtatcgctggtcaatgatggccccgtgacattctggttgcaggtatgagccagcttccagggttgtcacgggaaacaagagagagtatcgctatgtatcaccttcgggttccacaaacagaagaagaattagagcgttactatcagtttcgctgggaaatgttgcgtaagcccctgcatcaaccaaaaggttcggaacgcgacgcgtgggatgcgatggcgcatcaccagatggtcgtcgacgagcagggtaatctggtggcggtaggccgactgtatattaatgccgacaatgaagcgtccattcgctttatggccgttcatcccgacgtgcaggacaaagggttaggcacgctgatggcgatgaccctggagtcggtggcgcgtcaggaaggcgttaagcgcgtgacctgtagcgcccgtgaagacgcggtggagtttttcgccaagctggggtttgttaatcagggagaaatcaccacgccaaccaccacgccgattcgccattttttgatgattaagcccgtcgccactctggatgacattctgcatcgcggcgactggtgcgcgcagctgcaacaggcgtggtacgaacatatcccgcttagtgaaaaaatgggcgtgcgcattcagcaatataccgggcaaaaatttatcactaccatgccagaaaccggcaatcagaatccgcaccatacgctgtttgccgggagtttattctcactggcgacgctcaccggttggggacttatctggctgatgctgcgtgaacgccacctcggcggaacgattattcttgcggatgcgcatatccgctacagcaagccgattagcggtaaacctcatgcggtagccgacctcggtgccttaagcggcgatctcgaccgtctggcgcgcggacgaaaagcacgggtgcagatgcaggtcgaaatctttggcgacgagacgccgggtgcagtgtttgaaggcacgtatatcgttctgcccgcgaagccatttggcccgtatgaagagggcgggaacgaagaagagtagctgatggagaggggcggtgctgcctctctcattcaggtcatttatattagtccttggctatttcggttatattaaataagaactctataaatttttattcttcgttggctccatacgtgtcttgctacatcactgttcaggagcatttaaatattatttgtagaactgagtggcaattatcgcagataatgcttaattcatcatcttagttcatgtttgagcgatttttgatagtcaaaaccccctctggtgccatacttttctcataaatatttttaaaatctatagctaacaaatattatgcaaagataatggactagcatcattgtcagtatcattcatttactgctctgtatgttatgaataattatgttgtatgtttgctcttaaaccgtgggaaggaggctataatggttgccaatattaatctcattaaacaagaaagttattctgttgttaatttagaaaaacaactttcccgaactgttaccaacaaaattataacgatgagcaagtaaagaccggttggtggcagtactgaccggtctgtgatgaaagattaatttcaccttaaatcctggtgctgttaggatgctgacgtttttcggctacaccattcagattatgcaaataaatatctctgaatataatatattcatagcacccataattcatcctgggcgataactaaaccatttttgagtaataaatgaaacaactgcaacactcttattatttctggaaaacgcctcgcaaaaacaaaacaacatgcaaaaatccgctttttttaaatgattttccggcgtaattttcgcacatacattaatgagtaatatatgtaaggtattggtaatggcgatgaatacggtttttcttcatttatcagaagaggcaattaaacggctgaacaagcttcggggctggcgtaaggtttcacgatctgcaattttacgcgaagcggtagagcaatatctggaacgtcagcaattcccggtgcgtaaagcaaagggaggcaggcaaaagggggaggtagttggtgttgatgatcagtgtaaggagcataaggaatgacaaaaatttttcattcttgaatataaaaaacagatgcccttattctggtattaatacaaggctgttttacttgaacttataataactgcaactgttacatcatatctggaaaacgcctcgcaaaaataaaaaatgatgcgtaaatgagctttctttaaagattcggcaagggtacttttctctccatagattcaaaaatgatattggcgagatatttatgaactctctggcaggtatagatatgggcagaattttactcgatttatcgaatgaggtgattaagcaacttgatgatctcgaggtgcagcgtaatcttcctcgtgcggacctattaagggaagcggtagatcaatacctgataaatcaatcgcaaacagcaagaaccagtgttcctggcatctggcaagggtgtgaggaagatggtgtcgaatatcagcgtaagctgcgcgaggaatggtaatgggaaaaaatgatgtcaatcagattgctgacaacgtgcgcgttgtgcatgccggatgcggcgtgaacgccttatccggcctacaaagtcgtataaattcaatgtattgcagtttattggtagatactgttatggcctgcaagttttttcctggtccggtttcccggattgcaggcatgccagacacagcgccgtcaggcgctgtttttttcatcccttccgcgatttttacgccgctaccggattatgccgtgacgcatcgaacggcacgcctgacttcagcactccatacgccacctgtgccagcttgcgcatcatcgcgccgagaatcacctttcctttcttgccattagccgccagacggtcgcggaacgcccgtccccactcagtcttactggtggctaccattgcgggcatatacaacgccctgcgaagcgacacatgtccggccttactcattcggctcgcccctctcacactgctacctgattcataacgccgtggtgtcagacccgcaaaagcggcgaactgtctggcatgggcgaagcggtccttcagaccgatataagccagcaataccgcagatgttttctctccgatacccgggatgctttccagcagtttcctgcggtgtttcatatccggatcatcgtctgtcaggtcttttatctgcttctcaagacgcttcagctctgcttcaagccacagaaggtgagcatcaatgctcggtctctggacttcccgcgccgtttcagtgcgattcagttcctgcgtgtgcatatctgtcagcgcctggtggcggactaccagggcacgcaacgcgcgttcaagcgggtgaggcgcttcccaggctgcagggcgcttctgacgacagaactctgccagcatgcgcgcatccacggtatcagtcttgttacgcagtccttcactctgagcgaaagctttacccagcgcaggattaatgactgacactatgtagccagcatcgtaaaggcactcagcgacaggttccatataggtgccggtcgcttcgatgcagatatgcgcatggtcaatcttgtgacctttcagccagctcaccagctcatcgtgccctttagtggtgttagcgaattttttggtgcgatgacgaccatcaggacgcaacacatcgacatccagtttctctttagcggtgtcgataccgatataatgaagttcatgttccatagtgaaaccaaccttgcaaatacggattaccgggaaaaccggtccatgatactgtccggtttatcactttgggagaaaggcagtccgctgcataaatctacgcaacaggttagaacccaaggcccgatacggcatgcggactgcaggcagagaaaactggccgattttctctgcactggagggataatacaaggcctgataagcgcagcgcatcaggcaatcttacgcttgtcatcagtctcatgcccataaccttattgatgtggtggtgggtaaattgaggccaaaccggcactggcggcatagcttgaggtggtaacgcggaatacgagagatggtgtcgtcacaccctatgagctgtaatccgggcgacctgcgccacccggaaaacgtcagagattactctccttcacccggaaacaggaacgggttgatggaactgcgggcatagccttcttgctccattcgtgcgtccagtaccagagaggcgaggtcatctgctacggcttcgatttttggatctttttcctgatagagaattttcaggtaagtgccgcagtcatcgcagctttcggctttaatcgcggcctgttcgtcatccagcgaccagtaatgcagtttgccgctctgctcgcagttgctgcattttacgcgcactacgtgccattcagtttcacacaggttgcagtgcaggtaacgtagcccctgagtggtgccaatttgcaccatgctggacaccggcatagaaccacaaaccgggcaatattgacgttgctcgccgtattcagcgcgggctttgccggggatcagattggccatctgcgcccagtagagcgatagtgcagcccagataaacggcgctttatcgctgctgacggacgagaaatcagaggcaaacagcgcgctggccatatcttccagctcctgagtcgatgccttctccagattctcaatcactgccagcgccgggccgctcatttcaggtttcagctcagcaatcagcgccatcagcagcttttgccagtgcttatcacgcggcagaacgtgaatatccagcgggggcttgccttgtgcgctggcttctttaatgcgcgcagtcagatccatctccagcggatggtcgtacagcaccacttcctgggcgtgggcgataagcgcagcaaagcgcaggtaatcacccagaggattattttctgccagctcgcgcagacgctcggcgcggcggttgtataaattcttgagccgagggaacaataacggcggaatcatatccgccgtacgtttctcgcttgaacccagctcatcttgcgggattatgcgaatactcattcagctttcttttccgttgtcttgcggacctcacggtaccagcgcgggtgatgtttcttcgcccaggcgctggtaacccatccttccaccatggcggtaatcgtgcctttcacccaaagggcggcgtagatatgcaccatgataaccacaattaacgccactgcggcaaatgaatgcagcattaacgcgaatcggatcaccgggattgagaaagcaggcgcaaaataaggacgccagataatcacgccgctcaccagcagcagaaccaggaaaataatcgccgcccagaaaacgcatttctgaccgaagttataacgcccggtgtcacctacttcctcgttgacgacgatcttacgaatattcttcgcccaaaagatatcatcccgattgattaggttgtgatgccagtaacggaaaaacatgatgatgaacgaggcaaacataaccacgccgacaaacgggtgcagaattcgcgccagctgcggtgtgcccatgatttgcatcaaccagttgaaggacgggaacaaaaagcccagcccgctcaccgccgccaggatgaagcagaaggcggtgatccagtggttgatacgttccggcgcggtgtagcgcacgatggtgtcacgtcgtttcatttgcgctcctcgtctttctcttcgtgcagattattctcttcctcatccgcacggttcggaccgacacccacgtagtggaagatactggccgcaaaggtagccgcaaagccaacagccgcgagcggtttccagatgcctttccagaatttcacggtttcgctgatttccgggttctccggcaagccatgatacagatttggcttgtcagcatggtgcagcacgtacatgacgtgtgtaccaccgacgcctgccggatcgtacagacccgcattgtcgtaaccgcgggttttcagctcagcaacgcgctcgctcgccagcgttttcatcgactctttcgtaccgaagtgaatcgcgcccgttgggcaggtcttcacgcaggctggttcttgcccaaccaccacacggtcaacgcacagcgtacatttgtagacgcggttgtcttccgggttgaggcgcggaatgtcgaacggacagcccgcaatgcaataaccgcagccaatgcactgctcggactggaagtcgacgataccgttggcatactgaataattgcaccttccgccgggcacgctttcaggcagcctggatcggaacagtgcatacagccgtctttgcggatcagccattccagtttgtcgttctgctccacttccgagaagcgcattaccgtccacgatttggcgcttaaatcattggggttgtcgtacaccccaatgttattgccgacggtatcgcgaatgtcgttccactctgaacacgccacctgacaggctttacagccgatacaggtggtaacgtcgatgagtttcgccacttcttcctggaagtcccgcgcctgaggcgcgggggtcagaccgttagtcgcggaacgacgaatgatatcttgagattgataagccatatgtcgtctccgttacaccttttccacattcacaaggaaggacttaaactccggcgtctgcgtgttcgcatcaccaacgaatggcgttaaagtattggcaataaagccttttttagctacgccttcatagccccagtgaatcggaataccgatggtatcgatatctttgccgttcgctttcagcgtgcgaatacgtttggtcaccaccgctttggctttgatatagccacggttggaggagactttcacggtatcgccctgggcaatgccaagtttattcgccagcgactccccgatttccacaaactgctctggctgcaaaatcgcgttcaacagcgcgtgtttggtccagtagtggaagtgctcggtcagacgataggtggttccgacatacgggaacttatcggctttacccaatgcttcggcgtcgtctttaaagatacgtgcagccgggttcgagataacgtttggatgcagcgggttagttcccagcggcgtttcaaacggctcgtagtgttccgggaacggaccttccgccatcttatcgagggcaaacagacgccccatgccttcctgctgcatgataaacggcccgacgccgctacccggaggcgctgcgctgtagtccggaatatcccagccggtccacttagtgccgtcccatttcagcaactgacgcttcggatcccacgggttaccctgcggatctgcggaggcgcggttatacagaatgcggcggttaagcggccatgcccatgcccagcccagcgtgttaccgaggccagacggatcggcgttatcacggcgtgccatctggttgccttccggcgtccagctaccggcgaaaatccagcagccacaggaggttgtaccgtcatcgcgcaattgggcgaacgaactaagttgttggcctttcttgacgataaccgcaccggttgccggatcggtaatatcggccagcgccttaccgttgctctccatcgccacttcttctgaagatggctcatgcggaatggcgtagttccatgtcatgttcagcacctggtccgggttcgcgccaccctgttcggcatacatcttgcgcaagcgcaggaagataccggagaggatctcgccgtcagtcagcgcaatccccggggcgtccgcacctttccagtgccactgtaaccagcgacctgagttaacgatagaaccgttctcttccgcgaagcaggtcgatggcagacggaacacttcggtctggatcttcgacgagtcaacttcgttcagctcaccgtggttctgccagaagttagaggtttcagtgttcagtgggtcgatggtgacgaggaacttcagtttcgacagacaaccgatcactttgtttttgttcgggaatgaggcaacagggttaaagccctggcagatatagccattgaccttgccctctttcatcatctcgaagtattgcaggacgtcgtagcctttatcccacttcggcaaccagtcaaagccccagctattttccgccgtcgctttatcaccaaagaaggccttcatcatagagacgaagaatttcgggtagttgccccagtagtttacctggccttccagcagcggttttggcgtgttggcggtaaggtaggtttgcagatcggtctgcttctcgcttggcagcgtcatgtaacctggcaggctctgcgacagcagccccaggtccgtcagcccctgaatattggagtgaccgcgcagggcgttaacgccgccgcctgccatccccatattgccgagcagcagctggatcatcgccatcgtacgaatgttttgcgcaccaacggagtgttgcgtccagccgagggcatacaggaacgaggcagttttatcgtgagcactggtttctgcgatgtattcgcagactttcaggaacgcgtcttttggcgtaccacagatgttttcaaccacatctggcgtgtagcgggaaacgtgctgtttcagcaagttccacacgcagcgcggatgttgcagcgtggtatcgcgtttggcgaagccgttttcgtccagttcataagtccaggaggatttatcgtacttgcgtttttccgcgtcgtagccggtgaacaggccatcttcaaagccgtaatcctcacgcacgatcaggctggcgttggtataggcttcggtgtattcgcggttgaatttttcattgttcagcaggtacagcaatacgcctgacaggaaagcaatgtcagtaccggaacgaataggggcatagtagtcagctaccgccgccgtacgcgtaaagcgaggatcgatcacaatcagcttcgcgccgttgtgaattttggcttccatcgcccagcggaacccgaccgggtgagcttcagcggcgttaccgcccatcaccacgacgaggttggcgttcttgatgtcgacccagtgattggtcatcgcaccgcgaccaaatgttggagcaagacttgctaccgttggtccgtgtcagacacgcgcctggttgtcgaccgcgagcatacccagcgcgcgggagaatttttgcgttaaatagccggtttcgttactcgacgcggaagcacacagcatcccggtggagagccagcggttaacagtcacgccttcggcgttttgcgcaatgtagttagcatcgcggtcttctttcatcagtttggcgatgcgatcaaacgcctcttcccaactgatttgctgccatttatcagaacctggcgcacggtattccggaaacttcagacggctttcggagtggatgaaatccaccaggccagcgcctttcggacaaagtgcaccgcggttgaccgggtgatccggatcgccttcgatatggaagatagatgctttggcgttttttgctccgtcaccgaggctgtacatcaacagcccacagcctacggaacaataggtgcaggtattacgggtttcgcgggtgcgcagcagtttatactgccgggtttccgcgagtgctacgctgggtgcaaaacccagtgccgctgccgtggtgcctgccataccgccagcgcagatcttaaagaactgccttctgctgacctgcatggattgctccttgtttcgacattgtcacgtcccatttacattcgcttgctgcgtgtgcagggagtgggagttatttttctttgcggaaggggccgcaaaggtccagaattggctcaatttccctccatccaggaagggtttgtaacagaataccataatgttggtgtgtgtgttcttatctggttaagagaaagtgaaaaaaacacagcgaaaagaaatcgaaaatgtgacaaatatcacaggtgttcgtcaaattgagttatggcggcgtgatgatttacaacacccacggttagatgaggtcgcggaagaagttcccgttgcgctggtctacaacggcatttcgcatgtggtgatgatggcgtcgcccaaagaccttgagtactttgcgctcggtttttcgctttccgaggggattatcgaaagtccgcgcgatatcttcggcatggatgtcgttccttcctgtaatggtcttgaagtacaaattgagctttccagccgccgctttatggggttgaaggagcgccgccgggcgctggcgggacgtacgggctgtggcgtatgcggcgtggagcaacttaatgacatcggaaaaccggtgcagccgctaccgttcacccagacgtttgatctcaacaaactggatgatgcattacgtcatctcaacgattttcagccagtggggcaactgactggttgtactcacgccgctgcctggatgttgccatctggcgaactggtcggcgggcatgaagacgtgggtcgccatgtggcgctggacaaactgttaggccgccggtcacaagaaggggaaagctggcagcaaggtgcggtactggtttccagtcgtgccagttatgaaatggtgcaaaagtcggcgatgtgcggcgtagagattttgtttgcggtgtctgccgcgaccacgcttgctgtagaagtggctgagcgctgtaatctgacactggtaggtttttgtaaaccgggtcgggcaacggtttatacccatccgcagcgtttgagcaattaattaaaataagtcctgcgaaatatattaaattgcaggacttattcatttcgtgaattttattattttatttataaacaaaatgcgtgtagtggcgttttcttttttcatttattatgttcactctcttatctatatatttataaggcaattaaatgaaaaggaatttattatcttccgctattatagtcgccatcatgtccctcggtctgacgggttgtgatgataaaaaagccgaaacagaaacgctcccgcctgccaatagtcaacctgccgcaccagctcctgaagcgaaacctactgaagctcccgttgcaaaagcagaagctaaacctgaaacacctgcgcaaccggtggtcgatgaacaagcggttttcgacgaaaaaatggatgtctatatcaagtgctacaacaagttacagatcccggtacagcgcagtctggcgcgttatgctgactggctgaaagattttaaacaggggcctaccggtgaagagcgtactgtttatggcatctacggcattagtgaatccaacctcgctgagtgtgaaaaaggcgtaaaaagtgctgtggcgttaacgcctgcgctgcaaccaattgatggcgtggcggtgagttatatcgatgctgccgtggcgttgggtaataccattaacgaaatggataaatattacacccaggaaaattataaagacgatgcgtttgcgaaagggaaaacgctgcaccagacattcttaaaaaatctggaagcctttgaacctgtagccgaatcttatcatgcggcgattcaggaaattaatgataagcgtcagcttgcggaactgaaaaatattgaagaaagagaagggaaaacattccactactactctctggcagtcatgatttcagcgaaacaaattaataacctgatatcgcaagataagtttgatgcagaagcggcaatgaagaaagtgtctgaactggaaacgctagtggcgcaggccaaagaagcggataaaggcggcatgaatttctcgtttattaattcggcaggccagtatcaactcgaggctaaaaaatacgttcgccgcatcagagataaagtcccgtactctgactgggataaagagcaacttcaggacgcaaactcaagctggatggtcgaagactctttcccgagagcattacgcgagtacaacgaaatggttgatgactataatagcctgcgttaaacgtttttgatgataaatgcagtgtcggatgcggcgcatccgacacagttcaccccttgtgaagtaactccataaatgcctcatatcctgttaacccggcaataatctccgccggatgctgacacaatatgcttgccagatagctaaatatttttagctcatgacgcgcatcggcggcggcgcaggcgatcaagacatggttaatgacttcgttattcacctcaactggttgggcgagggtaataaaaaatccacgaaaacgtcgctcctgttcgctccagcaatgtgggatggcgaggcgattaacaatcaggttttcaccttcaccttcgccttcgcgggcgatgatgcgttgtgcttcatcggcggtaatatggtgttgtgcgactaattgcgcacaaatttgccgggtaatatgttgccagctttcaccgcgtacattcgaataatgaaaacttccgggggcagagaaaaaacgctccggttgctggcgaataaatgccgtcgccagaaaatgttttatttgttcgataccggcagccgtaatgatattttttacggtgatgtaattatttaccgcgtcatccagtaaataatggctgttgttaatgatcaataacggctcaatctcttcgcgaatggcaacaagctcgcttaagctacgggcaataatcacccgacaatttaaaacatcgcgctcaatggcgagctgattaatggtggcaatcgcgttctggtccgagagcaaaatgatcggctggcgttcgttttgatgccgctccagcgcacaggcaaaatacaaaccgagcagatcgctgtcgaaaaggggaatatcgagctgttcacgcagtagcgtaataaagtgcagactcatatcaaaggccgcaggccaggctgctttcaggttattcatgctgctttggcggtgctcagcaatccacactggtgcggcaaggcaacgtaataaatgcccggtaatgttctcaaccagccgcgtatcaataatattcaatgacgcgatgcccggcaccctttgcagcaaccgctgcacattatcggcagaaattatctgcgcttgctgatgctgtttctctatcaaacctgtcagggttcttacagcgttatcaccaagaaacatgccgctttgttcaacgatttgttttatctcgtcaccgggatattgcggccactcatcggtcagttgattacgcagggcgtaaatcgccagaatcaggctggagagataatcaccctgcatgagcggccagcggtgttggttgtcgcaggccgtggataaatgctgaaggttgtctcgtgttatgcccgccagcggaattaaaaacggatctttgcgcagcaagttcgccagcaagataacgcgtttctcttctgtctcatcaatgaaatggcccaaaccagggcggctggccaggcaacaagtgcgttcataacgctgttttaaccggggcagacgctctgctacccacgtttctggcaaattaagcgccgaggcgagttgcgcacggggagtgaaagtattcagtaataacagcgccagcagccgatcgtcgttatcgtgcttttgcagcaactgaaaaaagctgcggcgctcgaagatttccagctgatagcccgcactgccactggcgaaaatgcgggctttgccgttaagggtgaagttgagatagtcaatatcacgcaggatggtcctgcctgaaacgccagtctgttgcgccagctcgccaggcgtgcgcggctgttgctccagcagatcgacaatctttaactggcgttcgtttagcattaatccacctgacggaactggctaaacgcgttgactttctccgcagttaaggtcgtcagaaaaccccgtatcagcgtgagcagagcttcgtaatcggcttttgaaatcataccgctgttggcgtgcagataacgagttggcagacacagcgcgacaaccggacgcccgccgcccatcacgttgtagcgcccgccatccgtcgcaccggttttcatggtggaaaattgcagcggtaaatcgttatgtgcggcacagctttttaacgctgctaccagtttctggttggggaagtagcgcttgtcaaacagcatcagccccggcccctggcccagtttcagcgggtatttaatgttatcaatgcccggaacatcgcccgctacggcggtatccaacacgatcacgacgtccggtttaatgtgttccgccgaggtttgcgccccgcgtagcccaacttcttcttccacactgccaacgccatacagcgtaatttcgggattattcaccgtctgcaatagttcagccatcattgcgcagccgatgcggttatccaacgccttgccgaccactttatcttcgccccagcaggcaaaattggcttccgggctaataaaattaccaatttccacgccgcgcttttccacctcttcgcgactgttcgcgccaatatcaatgaacatctcatcaaatgacagcggttgttgcttttgcttttccgttaacgcatgaggcgcgacggaaccaatcacaccagggattttcactcccttgtgtgtgcgtatggttacccggtggttgagcatcgactgattccaccagccgccaatggtggtaaaacgcagaaaaccgctctcgtcgatgtgggtgaccataaagccgacttcatccatatgtccgacaacggcaacttttggacctttattccccttacgggcaacaaagctgcccagaccatcgaaggtgatttcattcacgcaaggttccagcgtgtttatcagaatgtcgcgaacttcctgttcatcgccgctgacggcgctggcttcgcacaactgttgcagtaactcaatgttcatggacaagctcctgttgcgcggctttcgctttgcggcgtaaccacaatcctttcaggacgataatgaatgaaatgttcagcgcgaggccaatcgccagcaccagataaaacgaacccaccggcgacatcaggccgatcagcgggtcaaagatacccaaaccaggtgccagacgtttgattccgaaagcgatcaccagcacgccggtaatgccgcccgccagcgtattggcggtaatcatcggcaacggagctgccagagcgtaaggaatagccggttcggttgcgactgtggcaccgaccacaatggcactactggcagcctctttttcctgtcgggtaaacagtttgggcgcaatgaacgtcgcaagacccgccgcgacgggcggcatcagcgcgacaacgccgacgatggcgtaccagccataaatgtgtttttccagcagtgagaagcagaagaaccaggcggttttattgatggggccgcccatatcgaacgccagcatcgcaccgaccagaaacgctgccgcaaacttcattgatggaggaatggtattcaggaagtggagcagcccgcccatgaggtcggacatcaccggcccgataacgtagtaagtgagcacgccgaaaaccagcagagtaacgaacgggatcagcattgaaccgagcagcggttgtaatgctttgccaaggcgcactttgcggaaccagaagacgaaatagccaatcgccagccccagcaccaccgcgccgaggaatcccgcacccgactgggtgccgagcagcgctttgtcgttcgccagatagcaaaccagaaacgccggagcgaaagccggtttatcggcaatcgacgaggcaatataagcgcccatgatggggatcataaaggtgaagccaaggtaaccgatggattcaactacccaggtaaacgacggcgcgcctttcgacatatcggtatacggcaaaccgaactgcaccagcatgttggcaagcgccaccaggataccaccgccgatgacaaacggcagcgccgcagagacgcccgccatcaggtggctcatcacgctaccgctttgcacttcctgtttgccaagcttcacgccgctatctgcggcaaaaagctgcgagtttgtcggtaattcgctgaaaatctggtcgatatttttcaacgcctgggagatggcaatctcataaactttcttcccggcaaaccgcgcgcgatcatcaccgctcaggccacgcccggtagcgagaatgacgtaatcggcagcggcaatctcttcgctggataagcggttttcaacgccactggacccttgagtttccacttttatggtatgaccgagagaacgggctttctgttccagggcttccgccaccatgtaggtgtgagcgatcccggcggggcagttggtgatcgcgacaatacgtaaggatgactccatcgccacttccttatgagctgagggtttgatttaacaaggcaagcacctggtcggtatcgccctgttgcagttgatgaataaattccttgtgaataattttgcgacacagtgtgccgatgattttgacctgatcctcttcgccgctttgcggcacgccgaggcagatccagcaattcacgtcttcgccatcgctggctttccagtcaatagcctgcgctttgcgggcgaataatacgaacggttgtttaacgcaggcgcttttaccgtgcggcacggcgacaccggaaccaaattcagtagagtgcattttttcgcgcagcagcagggtttgcaggaactggtgtgagtcggtgataaaaccgttttgtaacgctattgtcgccaactgcttcagaacggaataagcgccattgccctgaatattcaggtcaatacagcttgcagtaagagctgccattaatcggactccataaaatatattttaatcaattgtaatggtggagcgattaagtgatgagaggcgatatgtcggtaaacaatgacaatttgagacagagtgaaaggtcagatttgcggagtaatgcacataatggttatttaaataaaccacatgaatcattaatgggttattcattatttttgtgatttactcacaatgtatcagggaaatataacttaccgggagatgtaatatgtttaatttttcaaatcgaaatttaaaatattgtgccggaggcatctctggcacattgggcaattacggcaggtaaaacacttcttgcagctcgctactcaccgggctgttatccgggttagcgggcataacatcggtcatatatttccaccaacgttggcaaacatcagtgctggcaaccgcattccagcgttcttcagattcaatctctaccatggcaaacagcagattacgcgctttgtcgagatagatggcgtagttatgcgcaccgtgagatttcagcactgcttccagttctggccagatgggattatgccgacgctgatactcttcgtgggcgtcggggtttacctgcatgacaaaggctttgcggatcatgtttgctccttacagcgccagcgcactggcgagtggcgtaacgccgaaacgcttgccgagcgctatcaactcttcacggctgatggtctgtttcatgccgcccatcgaataaaccttcactaatacttgtgctgatttttctgcggtgtcgattaaaccgaaggtttcatccagcgtcggtccgctgccgaagacgccgtggaagggccacaacaccagcgaatgtttttgcatctcttgtgcggtcgcctggccgatttcgtccgtgccgggcaccatccacggcaaaatgccaacgccatccgggaataccaccagacactcggtgctgccttcccacagttggcgagtgaagaccgcggtgtcgttttcaagtacataggtgagggcgatcaggttggtggcgtggcagtgcatgatcacccgatctttgccgttggtggctttaatgcgctcgcagtgggaaaggaagtgagccggaagttcggaagtggggacggcttcgttggttaacccccaaagaatgtggtagcccgcgccgtcgctgtcgacttttacgatgcctaagttagccgcaggatcaagctggacgttacggaagaatttgcccgagccggtgacaataaacggtgtatttgccagtaaaggcatgggctggctgagcgggatatagcgcggttgttggtggaaattgtcgtgatatggtgcgatatcggcgtcatccaggcgtagcgtcaggttgccgccgttgcgctcatcccagcctttcagccaggcgtcggtggtggctttgatcattccctggacaaaccaggactgagtaatgttttgcatgttctgtgttcctgtaaattcggtgttgtcggatgcacgacccgtaggccggataaggcgctcgcgccgcatccggcaatcaatgcctgatgcgacgctgtcgcgtcttatcaggcctacaactattgccgacctgtaggccggataaggcacttgtgccgcatccggcaatcaatgcctgatgcgacgctgtcgcgtcttatcaggcctacaactgttgccgacccgtaggccggataaggcgctcgcgccgcatccggcagtgtttacccgcggcgactcaaaatttctttctcataagcccgcacgctctccagccattcgctacctgctggcgtatcgtgacgttggcaatacatttcccagaccgcctgccacggcaacgatttctgctcttccagcagtgccagacgcgcagtgtaatcgcccgccgcttccagcttgcgcagctcagcggtaggttccagcaacgcacgcagcagggcttttttcatattgcgtgtaccaatgacccacgcggcaatgcggttgatagaggcatcgaagaagtcaaggccgatatgcacccggtcaaacagatcgtgacgcacaatctcactggcaattgcctgggtttcatcatccagcagaactacgtgatcgctgtcccagcgaaccggacggctgacgtgcagcagcaactgcggcacatacagcatggcggcggaaatcttgtcggaaatcacttcagtcgggtggaaatgcccggcgtccaggcacagcgccgtctggcggctggtggcataccccaggtaaaactcattggagccaaccgtgtagctctccgcgccaatgccaaacaatttgctctcaacggcgtcgatatggtgcgcagggtttagcttctcgctgatcacctcatccagtgctgccagcagacgctgacgcggggcgagacggtcaacggtgatatctttcataccatccgggatccagatgttcatcaccgatggtgtgccgagttgctcgccaaaataggccgaaacgcgacggctagctttgcagtgatcaatccagaactggcgaatgctgtcgtcggcatgggaaagcgtaaagccatcggcgcttagcggatgcgaaaaacaggaggggttaaaatccagaccgagctgattggctttcgcccattcaacccagtttttgaagtgctctggtttgatctgatcgcgcgagacaggcgtgtctgattccagatagatggcatgtaaattaagccgtttcggccccggaatcagccgcatagcttgttccagatcggctcgtagctcactggcattacgcgctttgcccggataattaccagtagcctgaatcccaccggtcagcgaaccttccgggttttcaaaaccggaaacatcatcgccctgccagcagtgcattgaaacgggtaaacgatcaagttggcgcagcgcctcctcgacatcaatccctactgccgcgaaacgctgtttcgccagctcccaggcctgttccagttgagtggtcatgcgcaaagctcctttgtctgtcgtgtagagtgaatccgcgccacatagtgggcaatttcactgtcaggattaggggtaaaggtggtcagattcgcggtggtgctgacgacctgacggaaatcatccacattgttgagttcatccagcgtcattaactggatgccgatattgccgagcgtcgaggcttcaacaggcccggcgatcacccgaataccgcaggcatcggcgcatagctggttgagcagcgtgttctggcagcctccgccgacaatatacagttgcgagaaatcttcaccgcgcagctgcgccagctcatgcaacacatcggcatacagcagcgccagactgtcgaaaatgcagcgcgccagttcagcatcactttccgggatcggttgcgccgtttcccgacacgcagcctgaatttcgctgcacatcgtctcaggattaataaagcgatcgtcattgggattgataatgaagcggcaagccggaagtgcctgtgtcgcggagataagcgccggaagatcgttgatttgctgctcctgaagcactcgctgaagcagccataagcccataatatttttcagcacccgatagcgaccttccgccccgccttcattggtgatgttggctgccagtgccgtgtcattggtaaatggcgtctggctttcgaagcccatcaatgaccaggtgccagaagagagataagcagcacgtgagccgtttaacggcgaggcgataaccgcgctggcggtatcatggctggcaacggcgaccactggaatctcattaccctgcgggcaaatccagtgacctatgacattacccggatgcgtcgggcgaccaaaccaggctttgttggccccgctccacgccagtagcgactcgtcccagtcgtcgctattgatattgaccagttgcgtggtcgtggcgttggtatattcccagttcatcttgccggtcaggcgataactgaagtaatccggcatcagcagagcgtgagcaatgtgtggaataagttcaggttgttgctccgtcagcgcacgcaactgataaagcgtattgaagggcagaaactggatgccgctacgttgataaatatcgcgtttgccgagttgttgttgtgcctgcgccattaggccattggtgcggctatcgcgataagcaacgggcaggcccacacgctgaccctgttggtcgagcagcacaaagtccacgccccaggtatcaatcccaatgctatcgatacgaatcccttcctcgcacaccttgtttaatccaaggcgaatggcactttcaaggctatccacatcccaggtgacatagccgttctgactatgcagcccattgttaaaacgatggatttcgcgcagcgtcaggctgcggcattcacgctcgtaacgcgccagcatcacgcgcccactggatgcgccgagatcgacggcgacacaattgcgaaaggtcataatgtgatcctgctgaatttcattacgaccagtctaaaaagcgcctgaattcgcgaccttctcgttactgacaggaaaatgggccattggcaaccagggaaagatgaacgtgatgatgttcacaatttgctgaattgtggtgatgtgatgctcaccgcatttcctgaaaattcacgctgtatcttgaaaaatcgacgttttttacgtggttttccgtcgaaaatttaaggtaagaacctgacctcgtgattactatttcgccgtgttgacgacatcaggaggccagtatgaccgtattacatagtgtggatttttttccgtctggtaacgcgtccgtggcgatagaaccccggctcccgcaggcggattttcctgaacatcatcatgattttcatgaaattgtgattgtcgaacatggcacgggtattcatgtgtttaatgggcagccctataccatcaccggtggcacggtctgtttcgtacgcgatcatgatcggcatctgtatgaacataccgataatctgtgtctgaccaatgtgctgtatcgctcgccggatcgatttcagtttctcgccgggctgaatcagttgctgccacaagagctggatgggcagtatccgtctcactggcgcgttaaccacagcgtattgcagcaggtgcgacagctggttgcacagatggaacagcaggaaggggaaaatgatttaccctcgaccgccagtcgcgagatcttgtttatgcaattactgctcttgctgcgtaaaagcagtttgcaggagaacctggaaaacagcgcatcacgtctcaacttgcttctggcctggctggaggaccattttgccgatgaggtgaattgggatgccgtggcggatcaattttctctttcactgcgtacgctacatcggcagcttaagcagcaaacgggactgacgcctcagcgatacctgaaccgcctgcgactgatgaaagcccgacatctgctacgccacagcgaggccagcgttactgacatcgcctatcgctgtggattcagcgacagtaaccacttttcgacgctttttcgccgagagtttaactggtcaccgcgtgatattcgccagggacgggatggctttctgcaataacgcgaatcttctcaacgtatttgtacgccatattgcgaataatcaacttcgttctctggccgaggtagccacggtggcgcatcagttaaaacttctcaaagatgatttttttgccagcgaccagcaggcagtcgctgtggctgaccgttatccgcaagatgtctttgctgaacatacacatgatttttgtgagctggtgattgtctggcgcggtaatggcctgcatgtactcaacgatcgcccttatcgcattacccgtggcgatctcttttacattcatgctgacgataaacactcctacgcttccgttaacgatctggttttgcagaatattatttattgcccggagcgtctgaagctgaatcttgactggcagggggcgattccgggatttaacgccagcgcagggcaaccacactggcgcttaggtagcatggggatggcgcaggcgcggcaggttatcggtcagcttgagcatgaaagtagtcagcatgtgccgtttgctaacgaaatggctgagttgctgttcgggcagttggtgatgttgctgaatcgccatcgttacaccagtgattcgttgccgccaacatccagcgaaacgttgctggataagctgattacccggctggcggctagcctgaaaagtccctttgcgctggataaattttgtgatgaggcatcgtgcagtgagcgcgttttgcgtcagcaatttcgccagcagactggaatgaccatcaatcaatatctgcgacaggtcagagtgtgtcatgcgcaatatcttctccagcatagccgcctgttaatcagtgatatttcgaccgaatgtggctttgaagatagtaactatttttcggtggtgtttacccgggaaaccgggatgacgcccagccagtggcgtcatctcaattcgcagaaagattaattcgccatgccgatgccgacgatgttagcggcgacaataatcaccacacaaccgaggctcaacaccgttaccggacggcgtcctgcattgttccactctttcagcaccagcccgacgataccgccgcacaatacatagaaactcatatgcagcatccaactgatgtagtcatactgcgccggaatgcgggcgtggccccaggcatagaaaaagaattgcagataccacatcaacccgcccagtgtcgagagtaacacattgtgaatgatcagcgattttgccagcgagaagtcggcttttagcgacaaatccttcacttttgccagacgaataaaacagaaaccgaggttaatgatcgcgccgccgcccatgatgacaacatagcttggcagagcgacatacagtggatcgacgccaagtgcggcagcggcttcatgcatcggttttgcggcgttcatcgcaaaggacatcccggcagagaaaatgccgcacatcaccgccagcaccagcccttttttcagattgaactcttcggctttaatgcccatcttgcgctctttcaactgcccggcgcgagttacaatccctacgccaatcagcgccaccagaacgccgagcaacgtcatgcgtccgccttcggtgctaatcaacacatcgaaattgccgttgataattggcgtcatcagcgtaccgacaatcaacgtaatgccaatggcgatgccaattcccatcgacatgccgagataacgcatggtcaggccgtagttgatattaccgatcccacacatagcgccgaacagaaaaacaggcagtagcgtagagagactaaacgagctgtaatacgcccagaaattcggtagtaacagggcgctgatggcccacggcagaataatccacgaaacaatcccaccgactgaccacatggtttcccatgaccatttttttacttttttgaacggagcgtaaaaacaggctgcactggccgcgccgatcaaatgccaaaatatccccatcgtaatcgcgttactcatcttcttatcctcatcatttttcgtcgcgtcacatctccgacgagatgagtgtaaaaatcgtgctgtcgattaacctttcgcctgttgccgccgttgtcgatttactggcaatcacggcattaagtgggtgatttgcttcacatctcgggcattttcctgcaaaaccatacccttacgaaaagtgcggcattgataatcattttcaatatcatttaattaactataatgaaccaactgcttacgcggcattaacaatcggccgcccgacaatactggagatgaatatgagctataccctgccatccctgccgtatgcttacgatgccctggaaccgcacttcgataagcagaccatggaaatccaccacaccaaacaccatcagacctacgtaaacaacgccaacgcggcgctggaaagcctgccagaatttgccaacctgccggttgaagagctgatcaccaaactggaccagctgccagcagacaagaaaaccgtactgcgcaacaacgctggcggtcacgctaaccacagcctgttctggaaaggtctgaaaaaaggcaccaccctgcagggtgacctgaaagcggctatcgaacgtgacttcggctccgttgataacttcaaagcagaatttgaaaaagcggcagcttcccgctttggttccggctgggcatggctggtgctgaaaggcgataaactggcggtggtttctactgctaaccaggattctccgctgatgggtgaagctatttctggcgcttccggcttcccgattatgggcctggatgtgtgggaacatgcttactacctgaaattccagaaccgccgtccggactacattaaagagttctggaacgtggtgaactgggacgaagcagcggcacgttttgcggcgaaaaaataatcatttgccgcctgctgcaatgaggcgtataggccgcatatcagcttaaaaaatgaaccatcgccaacggcggtggtttttttgtgatcaatttcaaaataaaaacaatgatccgataaaaataaaacagcgtttcaattgatgtggttttgatcacttttattgattaaatgaatgtctatcttcgtttccatcaacactgatgctccattgaggaatgacgcatcagcccttaaaaatatgccgacaggtgatggaaatgcagataaaacgctcgattgagaaaatcccgggggggatgatgctcgtcccgctattccttggcgcactgtgccacaccttctcgccgggggcggggaaatattttggatcattcaccaacgggatgattaccggtacggtgcccattctggcggtgtggtttttttgcatgggggcgtcaataaaattaagcgcgacgggaacggtattgcgtaaatccggtacgctggtggtaacaaaaattgccgtcgcgtgggtggttgcggcaattgcctcgcgcattattccggaacatggtgttgaagttggattctttgccggactttcaacgctggcgctggtggcggcgatggatatgaccaatggcggactttacgcttccatcatgcagcagtacggcacaaaagaagaagctggggcatttgtgttgatgtcgttggagtccgggccgctcatgacgatgattattctgggcactgcagggattgcctcgtttgaaccgcatgttttcgtcggcgcagtattaccgttcctggtgggctttgccctggggaaccttgaccctgaattacgagaatttttcagcaaagcggtgcaaacgctgattccattctttgccttcgcgctgggcaataccattgatttgactgtgattgcccagactggtttgctggggatcctgttgggtgtggcagtaattatcgtgaccggtattccgttgattatcgccgataaattgattggcggtggcgatggcactgccggaattgccgcttccagttccgcaggggccgcggtagcgacacctgtgctgattgcagaaatggtgcctgcgtttaaaccgatggctccggcagcaacttcgctggtagcgacggcggtcattgtgacttcgattctggtgccaattcttacctctatctggtcacgtaaagtcaaagccagagcagcgaaaatcgaaattttaggtacggtgaaataaacctgcttccttaatccccacagccggatgaactaacgttcgtccggtttgctattgagttcctgcctggatacttaccgcgaaaacagcacgcctgacataaaataaatatggtctaatggggaaatttctcgtggagagggaacagatgcgatatccggttgatgtatacacaggcaagattcaggcttatcccgaaggcaaacccagcgcaattgccaaaatccaggttgatggtgagttgatgctgacggagctggggctggaaggtgacgagcaggcggagaaaaaggttcacggcgggccagacagagcgctgtgtcattatcctcgtgagcactatctctactgggcgcgggaatttccggaacaggcggagttgtttgttgcgcctgcgtttggcgaaaatctctcaaccgacggtctcacggaaagtaatgtttatatgggcgatattttccgctggggagaggcattaattcaggtcagccagccgcgctcgccttgctataaactcaattaccattttgatatcagcgatatagcgcagttgatgcaaaacacgggtaaagtggggtggttgtatagcgtgatagcgccagggaaagtgtctgcggacgcgccgctggagttggtttcccgtgtcagcgatgtgaccgtgcaggaggctgccgccatcgcatggcatatgccgtttgatgacgatcaatatcaccgtttactctccgccgccgggttatcgaaaagctggacgcggacgatgcaaaagcgccgactgagcggcaagatcgaagatttttcccgccggttgtggggaaaataacccccggagtgtaggcctgataagacgctatcagcgtcgcatcaggcatcctgctcaaatgccggatgcggcgtaaacgccttatcctgcctacaaatgcggagtttaactccgcttatacagcggcaaccaaatcaccagccgtaaaccgcccagcgggctgtcttctgccttcacccagccacgatgctgctgaatggcggtttcaacaatcgccagccccaatcctgtaccgccagattcacgatcgcgtgcttcatcggtccgatagaacggacggaaaatctgttcgcgatcttccgggctaacgccaggaccatcgtcgtccaccgtaatggtgataccgtctttatctaccgcaaagcccacttcaatcttcgtatgggaataacgcagagcattacgaacaatgttttccagcgcactttccagggcgttcggattgccgtacagcggccacggcccaggcgggaagttaaccgtcaacgacttgcccatctgctcggcttcgaacgccgcgttatccagcacttcactccacaactggttggctttgatggtttcgctaaccagcgcgtttttttgctgattacgggacatcaccaacagatcgttgatcatgctgtccagacgttgcgcttcggtttcaatacgctccagttccttgctttcaccgctacgacggcgcagtaacgccgtacccagttgcagacgcgtcagcggggtgcgcagctcgtgagagatatcagaaagcagacgctgctgagaggtcatcatgcgctccagcgcggtgaccatctggttaaaactggcacctgcggcaaggaattcctgtggccccgcttccagttccgggtgctggcgtaagtttccctgggcaacttcatcggcagcgtttttcagcttacgcgccggttttgccagactccaggccaaccacaacagcagcggcgtactgaccaacatggtgacaatcagcagtaatagcgggcggtcaaacagtaagttaatgaaatcggattgagaactgctggccggacgaatcagataaagttggtaattatcttcgccatcacgtacggagaacggaccgaccagttccacgcggccatactttttcttctgcggatgatcggcgttatcggcctgaccaataaagttacgaatgatctgcatttcgctgcgttcagcgccgatcacgcggccttcggtggtcaccaataacaaacgctgtcctggcggtgcccacttatcaatcgcccggaacagacgccgccaccacattaaatcgttgggcggatcgttcgccagctccgcttcaacatgctgctcaatcatcagcccctgacgctgttcgctatccagaagctcggtcatctggcgtgaatcgagcttgggtaacatcaaaaccaacatcaacaccagcgccagcgtcagccagaagatggcgaagatgcgcgcggttaagctgcctatcatgaagcagaaaccatcaggtagccgcgaccacgcaaggttttaaaccacgggtgaccatctttacgatccggcagtttacgacgcaggttggaaatgtgcatatcgatagcgcggtcgaaaggcgtcaggcgtttgcccagcacttcctggcttaaatgttcacgggaaaccacctgacccagatgctgtgccagcaaatagagcagggtaaactcagtaccggttaactccagcgtttgcccgtcgaagctggcttcctgacggcctggattcagcactaaggcatcaacttccagtgtcggtgaaccgttgtcgttgttttgctgttgctcgctccagtgcgaacggcgcaggatcgcgcgaatacgtgccaccagctcacgatcattaaacggtttcgggagatagtcatctgcgcccagctcaaggccgagaacgcgatcaagttcactgccgcgcgccgtcaacataatgacaggcgtctggtgtgtctggcgaagtgcttttaatgtgtcgataccatttttcttcggcatcattacgtcaagcaaaagtaaatcaatgctgtcgtccagaagatcaagcgcctgttccccatcgtgggcaacaatcacgttgaagccttccatctcgagcagctcctttaatagggaagtcagctctcggtcatcatcaactaacaggattttattcattgtttaaatacctccgaggcagaaattacgtcatcagacgtcgctaatccatgactttacgttgttttacaccccctgacgcatgtttgcagcctgaatcgtaaactctctatcgttgaatcgcgacagaaagattttgggagcaaatgatgcgcatagttaccgctgccgtcatggcctcaacgctggcagtcagttcattaagccacgctgctgaagtcggttcaggcgataactggcatccgggtgaagaacttacgcagcgcagtacgcagagccatatgttcgacggcataagtttaaccgaacatcagcgtcagcagatgcgagatcttatgcaacaggcccggcacgaacagcctcctgttaatgttagcgaactggagacaatgcatcgccttgtcaccgcagaaaattttgatgaaaacgctgtgcgcgcacaggcagaaaaaatggcgaatgagcaaattgctcgtcaggttgagatggcaaaagtccgcaaccaaatgtatcgcctgttaacgccggagcagcaagcggttttaaacgagaaacatcaacaacgaatggagcagttgcgcgacgtgacgcaatggcaaaaaagttcatcgttgaagctattgagtagtagcaactcacgttcccagtagtaaaccctgttttccttgccatagacaccatccctgtcttcccccacatgatgtgggggttttttttatcctcaatttgcctgctgcttaatgcattgcagatgatttgcttccgttatactagcgtcagttgatagcgggagtatttatgaatcaatcttatggacggctggtcagtcgggcggcgattgctgcgacggcgatggcttcgttgctattgctgattaaaatttttgcatggtggtataccgggtcggtgagtattctcgccgcgctggtggattcgctggtggatatcggcgcgtcgttgacgaatttactggtggtgcgatattccctgcaacctgccgacgataatcactcgtttggtcacggtaaagcagagtccctcgcggcgctggcgcaaagtatgtttatctccggttcggcactattcctgtttttgacgggtattcaacatctgatatctccaacaccgatgacagatccaggcgtcggggttatcgtgacaattgtggcgctaatttgtacgattatccttgtctcgtttcagcgttgggtggtgcggcggacgcaaagccaggcggtgcgggctgatatgctacattaccagtctgatgttatgatgaacggcgcaattctgctggcgctggggttgtcctggtacggctggcatcgcgccgatgctctgtttgcattgggaatcggcatctatattttatatagcgcgttacgcatgggatatgaggcggtacagtcattactggatcgcgcattgcctgatgaggaacggcaagaaattattgatatcgtgacttcctggccgggtgttagcggcgctcacgatcttcgcacgcggcagtcagggccgacccgctttattcagattcatttggaaatggaagactctctgcctttggttcaggcacatatggtggcggatcaggtagagcaggctattttacggcgttttccgggatcggatgtaattatccatcaggacccctgttccgtcgtacccagggagggtaaacggtctatgctttcataatcagtataaaagagagccagacccgcattttgtgtataaaataccgccatttggcctgacctgaatcaattcagcaggaagtgattgttatactatttgcacattcgttggatcacttcgatgtgcaagaagacttccggcaacagattttattttgcattccaaagttcagaggtagtcatgattaagaaaatcggtgtgttgacaagcggcggtgatgcgccaggcatgaacgccgcaattcgcggggttgttcgttctgcgctgacagaaggtctggaagtaatgggcatttatgacggctatctgggtctgtatgaagaccgtatggtacagctagaccgttacagcgtgtctgacatgatcaaccgtggcggtacgttcctcggttctgcgcgtttcccggaattccgcgacgagaacatccgcgccgtggctatcgaaaacctgaaaaaacgtggtatcgacgcgctggtggttatcggcggtgacggttcctacatgggtgcaatgcgtctgaccgaaatgggcttcccgtgcatcggtctgccgggcactatcgacaacgacatcaaaggcactgactacactatcggtttcttcactgcgctgagcaccgttgtagaagcgatcgaccgtctgcgtgacacctcttcttctcaccagcgtatttccgtggtggaagtgatgggccgttattgtggcgatctgacgttggctgcggccattgccggtggctgtgaattcgttgtggttccggaagttgaattcagccgtgaagacctggtaaacgaaatcaaagcgggtatcgcgaaaggtaaaaaacacgcgatcgtggcgattaccgaacatatgtgtgatgttgacgaactggcgcatttcatcgagaaagaaaccggtcgtgaaacccgcgcaactgtgctgggccacatccagcgcggtggttctccggtgccttacgaccgtattctggcttcccgtatgggcgcttacgctatcgatctgctgctggcaggttacggcggtcgttgcgtaggtatccagaacgaacagttggttcaccacgacatcatcgacgctatcgaaaacatgaagcgtccgttcaaaggcgactggctggactgcgcgaaaaaactgtattaatgatttcggaaaaaggcagattcctttagcctgaaaccgatgacagaagcaaaaatgcctgatgcgcttcgcttatcaggcctacatgaattctgcaatttattgaatttgcaaacttttgtaggccggataaggcgttcgcgccgcatccggcatggacaaagcgcactttgtcagcaatatgaggcggatttcttccgcctttttaatcccccaacatatacccgcaagttatagccaatctttttttattctttaatgtttggttaaccttctggcacgctttgctcatcacaacacaacataagagagtcgggcgatgaacaagtggggcgtagggttaacatttttgctggcggcaaccagcgttatggcaaaggatattcagcttcttaacgtttcatatgatccaacgcgcgaattgtacgaacagtacaacaaggcattcagcgcccactggaaacagcaaactggtgataacgtggtgattcgtcagtcacacggtggctcaggtaaacaagcgacgtcggtaatcaacggtattgaagctgatgttgtcacgctggctctggcctatgacgtggacgcaattgcggaacgcgggcggattgataaagagtggatcaaacgtctgccggataactccgcaccgtacacttccaccattgttttcctggtacgtaagggaaatccgaagcagatccatgactggaacgatctgattaaaccgggtgtttcggtgatcacgcctaatccgaaaagctctggtggcgcgcgctggaattacttggcagcctggggctacgcgctgcatcacaacaacaacgatcaggcaaaagcacaggattttgttcgggcactgtataaaaacgtcgaagttctggattctggcgcgcgcggctccactaacacttttgtcgagcgcggaattggcgatgtactgattgcctgggaaaacgaagctctgttggcagcgaatgaactggggaaagataaattcgaaatcgtcacgccgagtgagtctatcctcgcggaaccaaccgtgtcggtggtcgataaagtggtcgagaaaaaaggtactaaagaggtggcggaagcctacctgaaatatctctactcgccagaaggtcaggaaattgccgcgaaaaactactaccgtccgcgcgacgctgaggtggcgaaaaagtacgaaaatgcgtttccaaagctgaagttattcaccattgatgaagagttcggcggctggacgaaagcgcaaaaagagcattttgctaacggcggtacgttcgatcagatcagcaaacgctgatttccccaggataattatcaaacccggtggtttctcgcgaccgggttttttatttgtcacgattttgcgttacccttgcatctctttgaggtacagggaaaaaaagatgaaaaaagcgggtcttctttttttggtgatgatagttatcgccgttgtggctgccggtattggttactggaaattaaccggtgaagagtcggatacattacgtaatattgtccttgaggaatgtttgcccaatcagcagcaaaatcaaaatccttcgccatgtgcggaagtcaaacccaatgccggatacgtggttttaaaagatcttaatggtccactgcaatatctgttgatgccaacgtatcgtattaacggtactgaaagtcctttgttgaccgatccttcaacgccgaacttcttttggttggcctggcaggcgcgtgattttatgagcaaaaaatacggccagctggttcccgatcgcgcggtttctttggcgatcaactcccgcaccgggcgtacgcaaaaccattttcatattcatatctcttgtattcgtcctgatgtgcgcgaacaactggataacaatctggcgaacatcagcagccgctggttgccactgccaggtggtttgcgcgggcatgaatacctggcgcgtcgggtaacggaaagcgaactggtacaacgcagcccatttataatgctggcagaagaagtacctgaggcgcgggaacatatgggaagctacgggctggcgatggtacggcagagtgataactcatttgtattgctggcgacacaacgaaatctactgacgcttaaccgtgcttcagccgaggaaattcaggatcatcagtgtgagattttgcgttaaggcgaagagttaaggaaagtaagtgccggatatgaaatccggcacctgtcagacttaagcctgtttagccgcttctgcagctttaacgatcactgcgaaagcgtcagctttcagagaagcaccgccaaccagcgcgccgtcgatatctggctgagcaaacagttctgcagcgttagacgcgtttacagagccgccgtactgaatgatcacttgttcagcgatgttagcgtcaactttagcgatgtggtcacggatgaatttgtgaacagcctgtgcctgagccggagttgcagatttgccagtaccgattgcccatacaggttcgtaagcgataaccgcaccttcgaatgccgcagcaccctgagttttcagtaccgcgtcgatctgacgtgcgcaaacttcttcagttttgcccgcttcgttttcagcttcggtttcaccgatgcacagaaccggagtcaggccctgctctttcagcaccgcgaattttttcgcgatcagttcgtcagactctttgtggtaagtacgacgttcagagtggccgatgatgatgtactgagcgccgatgtctttcagcatagcggcagaagtttcaccggtgaatgcgccggacaggttcaggtccacgttttgcgcacccagcatgatgtggctgccttcagcttcgcgcttcgccatatcgatgtacatttccggtggtgcgattgcaaccgcacagccagcaacacctgccagctctttacgcaggttagaaaccagctcgtgaaccatgtggcggctgccgttcagtttccagttacccatcactaaaggatgtcgcattttaattctccacgcttataagcgaataaaggaagatggccgccccgcagggcagcaggtctgtgaaacagtatagagattcatcggcacaaaggctttgctttttgtcatttattcaaaccttcaagcgattcagatagcgccagcttaatcggttcaacagcgaaggtcagccccttttcgccgttgtccgcgacaacataacgcagtgcaccttctgtctcggtgtaataacgtttgtttttccccgccgttagtagcgactgcagttttttctggctttgtgttttggtcattaatggggtgagtgtgcggatcaccgctgccatgtattcctgagctttcgctttcgcggctttttgctctggcccctggatgggtagccaggtcatttgaatgcttttgatttttaaggtaccgcgctccagcgctgtagaagcatacaagttctcattaattttacttgcagcacgagtgagattggctttgtcgggactgctgtcgatggcacgaaattcgttcagtggcaggctgggattctggctgttaaagtcttctcgaaactggctgatggagagatcgaaagtaggggctccagccagcagataaggcgcggtcgttgccgtatctggtgtttgtgcatgcgccgctgttgtaacggttaatgcagaacataagagaaaaaacagcgtacaccctggcttcattgacagtaccttttgttatgactggctccgattaaaacgatatctgtcgcccttgtcaaaagggtagaatcctggaaaagacaaccatcaaggaacttacatgaccatacagcaatggttattctcatttaaagggcgtattggacaccgtgatttctggatttggataggcctgtggttcgcaggcatgctggtgcttttctcactggcgggtaaaaatttactcgatattcagaccgcggcgttttgccttgtgtgcttgctctggccaacagcggcagtaaccgttaagcgcttgcatgatcgcgggcgttccggcgcatgggcatttctgatgattgtggcgtggatgctgctggcgggtaactgggcgattttaccgggtgtctggcaatgggcggtggggcgttttgtcccgacgttgattctggtgatgatgcttatcgatcttggtgcgtttgttggcacacaaggcgaaaataaatatggtaaagatacccaggatgtgaagtataaagccgacaataaatcaagtaattaacctttaatatatctcttactgctatttttttccgggattgttatttccacgatgaaaatgacaatgcccggaaaatccttctgaactcttcaccttaagcaatatcaaaaaaaatggtaatccataagatcattacttgtttgttcttcccttaacggcgcattattcttaagtcgtaatcgacagagaggcgaatatacagaggtgccctatgaaagatgtcgtagataaatgcagtactaaaggatgtgcgattgatatcggtacggtgattgataacgacaactgtaccagtaagttttcgcgcttttttgccacccgcgaagaagcagagtcttttatgaccaaactgaaagagcttgccgccgctacatcctctgcagatgaaggggccagcgtggcctataagattaaggatctggaggggcaagttgagcttgatgcggccttcactttctcatgccaggccgagatgattatttttgagttatcactgcgttcgttagcttgatggagttgctttagaaggagttaaacatggcttataaacacattggcgtggcaatttccgggaatgaagaagatgccttactggtgaataaagccctggagctcgccagacataatgacgctcacctgacgttaattcatattgatgatggcttaagcgagttgtatccgggtatctacttccctgcaacagaagatattcttcaattgttgaagaataagtcggataacaagctgtataaactgacgaaaaatattcaatggccgaagacaaaactgcgtattgaacgcggagaaatgccggaaacactgctggaaattatgcaaaaagagcagtgcgacctccttgtctgtggtcatcatcactcatttatcaaccgtttgatgccggcatatcgcgggatgatcaataagatgagtgcggatttgctcatcgtgccgtttatcgataagtaaccgcttaccagtaatgctccgctgtcatatggcccggtcggcgacgtaaatgtttcgtcatctgccgggtctctttcagcaactgttgtgtatcgcgcaccatctgtggattgccgcacagcatcacatggctggtttctttattcatcggcaggccaatcgtgctttccagttccccactttcaattaatgccggtatccgtccggtgagcgaccccgctgccgtttcccgactgaccaccgtctgaatgcgcagttttccttcgtagcgtttttccagttcctgcatcagtggcaaatagcttaagtcggcggcataacgtgcggcgtgcaccaggaccagatttttgaagcgatctaaatctttacctagttgcagaatcgataaataagggccaatcgctgtaccggttgccagcatccatagcgtttcgcagtgcggcacttcatcgagcacaaagaatcctgccgcttcgctaaccacctgcacttcatcgcctggtttcagtgccgccagtcgtgggcttaatttgccatcggggacggtgaccaggtaaaactccagatcgggattatcgggcgagtttacataggagtaggcgcgctggacgcgttcgccgtcgatttcaaggccaagcttggtaaattgcccggcggtaaacggaagcacgggggcgtgaacggtgagactaaacagggcgtcggtccagttctgcactttagtgactttgcctgttacccaatcagccatgtttttctcctgttttgattgacttgccttatcttcgttctccgaacaaaaaaattccagtcccgaaggactggaaggctcaatcgatcaaatcaatcagaggatgtgcacctgcatttccgggtctttgcgatccagatagtggatggactgaatgcggcgaatggtgcgtgacttgccgcggatcagcagcgtttcggtagtcgcgatattgcctttgcggctaatgccttccagcagatcgcctttggtaataccggtggcagagaagatgacgttatcgctgcgcgccatatcgcccaggcgcaatactttaccggcttcgatgcccatcgctttgcagcgtgccagctcctgctcgccaatgcgacgattctcttcgttgtcgcctttgacgtcatgacgcgccagcagacgaccgttcatgtcgccatctaatgcgcggatcaccgccgcagaaactacgccttccggcgcgccaccaataccgtacagcacgtcaacttcgctgtctggcatacaggtgagaattgaggccgcaacgtcgccgtccggaatagcaaatacgcgtacgccgagttgctgcatttcagcgataacggcatcgtggcgtggtttagccagaatcgttaccgtcagttcgctcaacggtttgccgagcgccgccgctacattgcgcaggttatccgccagcggcaggttcagatcaatggtgcctttggctcccggcccgacaatcagcttctccatatacatatccggcgcattgaggaagcagcctttatcgcctactgccagcaccgccagcgcgttagcctggcccatcgccgtcatgcgcgtgccttcaatcggatcaacagcaatatctaccgcgtcgccgcgaccagtaccgactttttcaccaatgtagagcatcggtgcttcgtcgatttcaccttcaccaatgacgatggtgccgtcaatgttgacctggttgagcataatacgcatggcgtttaccgccgcgccgtccgcggtgtttttatcgccgcgtcctaaccatttgtagccagccagcgccgctgattcggtgacgcgggaaaattcgatggcaagttctcgtctcatagcaaactctaagcagtaaggaatggcgcgaagtgtagcacaggggaagggagggattattgatgtgtgcggggttgcccccgcacgtttcgggactaccggatgcggcataaacgcttcattcggcatttacattattcgtcgtgttcttcccacgccatcgcgcgtttaaccgcttttttccagcctgcgtaacggtaattacgctcagtggtttcgatgcctggacggaactcgcgctcaatcaccgctttctcttgcagctcgtcgaggttctgccagaagccaaccgccaggcctgcgagataggccgcacccaatgcggtgacttcgcgcacttccgggcgctcaacgcgggtgccgagaatatcggactggaactgcatcaggaaattgtttgctactgcgccaccatccacgcgcagggcgtgcagacggataccagagtcggcctgcatcgcttccagcacgtcacgcgtctgataagcaatagactccagcgtcgcgcgtataatgtggttagcgttcaccccacgagtcagaccgaaaatcgccccgcgcgcatacgggtcccagtacggcgcacccagcccggtaaatgccggaaccacatacacaccattggtgttttgcactttggtggcgaaatattcggaatcgtaggcgtcgttaatcaacttcatttcatcgcgcagccactgaatggatgcgcctgccataaacaccgcaccttccaacgcatagttcacttcgccagtcgggccgcaggcgatggtggtcagcaggccgttttctgatttcaccgctttctcgccagtgttcatcagcataaagcagccagtgccataggtgttcttcgccatcccttctttcacgcacaactgaccaaacagcgcggcctgctggtcaccggcgatcccggagattggaatacgcgtgccgcctttgccgccaatgttagtctgaccgtatacttcggaagaacgacgcacttctggcagcatctcgcgcggaatatccagcacttccagcattttgtcgtcccagtccagggtatggatgttgaacaacatggtacgagaggcgttggtgtaatcggtcacatggacacggccctgagtcattttccagataagccacgtatcaaccgtaccaaacagcaattcaccacgacgtgcacgctcgcgagagccttccacatggtcgaggatccacttcactttggtgccagaaaagtacgggtcaatcaccagaccggtattgctgcggatataatcttctaaaccgtcacgttttaaatgctcgcagatttctgcggtacgacggcactgccagacaatggcgttatagataggcttgccggtttctttttcccagacaatagtggtttcacgctggttcgtaataccgatagctgcaatttgatcggaactgatatcggctttcgccagcacttctaccagcgtggagctttgggtggcccagatttccattgggtcgtgttctacccaacctggttttgggtagatttgctcaaattcgcgctgcgacacgctaatgatattggcatcgtgatccattacgaccgcgcgggagctggtggtgccctggtcgagcgcaacgatatattttttttcagtcatgtttaattgtcccgtagtcatattacagcgaagctttttgttctgaaggagttgtggtttccttttcttccacaacacagatatcgcaaggcaaatggcgaccaatcagtttgcggtaggcaaatgcacctacaatcgcgccaacgatagggccgaaaagcggcaccaggaagtaaggaatgtctctgccgccggtaaaggcgacattgccccagcccgccagccaggcaaagactttcggaccgaagtcacgcgctgggttcatggcaaaacctgtcaatgggcccatagatgcgccaatgaccgcaatcagtagaccaatcagcaagggagccaaagggccgcgtggtacaccgttgccatcgtccgttaacgccaggatcagccccatcagaatagcggtaatcaccatctcaactgcgaaagcctgcacaaaattgatatgaggattagggtaagtagagaaagtgccagccagatcaacactttcaacgctgccgcgaacaatgtgatgagtctgctcgaagtcgaaaaataaattgtagtaaagcccgtaaactaaagccgcagcacagaaagcgccggcaacttgtgaaacgataaaaggaataactttgcgcttgtcgaaacaggcaaacagccacaatgcaatggtaacagcgggattaagatgcgcgccggaaacccctgcggtcaggtagatggccattgccacccccagtccccaaatgacactgatttcccactgatcaaaagacgcaccagcgacttttagtgctgcaacgcaacccacaccgaagaaaatcaacaacccggtaccgaggaattcagcaatgcactggcctttcaaggttgatgtttgactcataatcggatcctgaagagttaatgtttgttgtatgcgtgaaagtcacggacctccacgatgcttgtaggcatgctgtaaacttatcgttaacgagcaaaaacgagaaatatcgaacttaaaatgtgtgtgcctcgtcataaaatgagcgttatcgcgccatttattccatctgattgtacatgatgcatgtttgttagatcattcgcgcaacaaatttattaacattttcgattgatgtggattatgtcaccaggagaaggatgaaaagtgtggcaaaccgtaatctgcaaggcgtgccgctggacagcgatggcgcggcttcatacaatcggagctaactaaagtgcgctcgtatttattaaggcgtcaccggtaatcgggacgaggatttttatccatcaacgccttgcaattcaggagaggtatgacaatgtcattagaagtgtttgagaaactggaagcaaaagtacagcaggcgattgataccatcactctgttgcagatggaaatcgaagagctgaaagaaaaaaacaactcactgtcgcaggaagttcaaaatgcccagcatcagcgcgaagagctggagcgtgagaacaaccatctgaaagaacagcagaacggctggcaggaacgtctgcaggccctgctgggtcgcatggaagaggtctgattacgcttcatcttccgcgtaatttctttactgtgtaggccaacaggtaacgcagaaaaaaggcaccttgcggtgcctttcttatcattcaatatccagcggatcttctgaaagaataatcccggtattgtcggcataaagatggtcgccggagaagaaggtgacaccgccaaaattgacgcggacatcgctttcgccaatgccttcgccagcggcaccaaccggaattgccgccatcgcctggatgccgatatccaactcttccaggtcatctacctgacgcaccgcgccgtaaatgaccagaccttcccattcattttgtactgccagacgcgccagttcagcatcgaccagtgcgcgacgaacagaaccaccgccatcgacgacaagaacacgaccacggccattctgttcgagcagatcgtacagcaacccgttgtcctcgaaacattttaccgtgattatttgtccgccaaacgacgcccgtccgccaaagttggagaacagcggttccacgacgttaacatcttcttgatagatgtcacaaagctcggaagtatcgtatttcataggcttaacattcagttgctgcgagaattttcagtatatcgcgctatgtgggctgttggcaaaatcatcaattgttaattgatatttgtcagttatgctgcccactggcttaggaatatccctaaaacaaacagcaggttagtcagtaacgctcccttgacagtacgttccagcattggtcgcatcgccaccgggtccatttcccgcatcacataacgggcttgcttcaccagtaatggtgccgccagcaggaacagccagccccacaggctatgcagcgaaaagagattaaacagcgccagacacaccagcgagcccatcagcaggcaggcatgataacgacgcgcgttcacttcacctaagcgcaccaccagcgtgtttttgccattttcgcggtcgctattgatatcacgcaggttattaatattcagtactgccgttgccagcaggccgcatgcggtcgccggaaggatcagtgccggaatcaatgtatgagcctgtaaataccagctccccatgacactcaaccagccaaagaaaaccagtacggaaatatcacccagaccgatataaccataaggacgattgcccacggtgtaggtgatagcggcaatgatcgacaacccgccaagaatcaggaaaccgacaaaatcggccagcgtatggcatgccactgcaaccagtgccagcccggagagacagatgagcacgacggtaataatgagcgcccgtttcatctcttgctgggtaatgacccctttttgcatgccgcgtagcggcccaatgcggtcaggtttatcgctgccttttaccgcatcgccgtaatcattggcgaggttagaaaggatctgtaatagcccggcggtaattagtgccagcagggcgaccagcggatcgaagtgaccttgccaccatgccagcgctgtcccgacgataattgcagcaaaggcgagggggagggttttaggtcgtaaactttccagccacgcctgagttcggctaatttgttgttcagtcataatacgcgccaataaaaatggggcctttcagccccatcaaacaatgatgaaaatgattgaacgcgattataggataaaacggctcagatcttcatctgccaccaacgcatccagatgtttgctcacataatctgcgtcaatagtgatattttgaccgcttaaatcgctggcgtcgtaggaaatctcttccattaaacgctccagaacagtgtgtaaacgacgagcaccgatgttttcggtagattcgttcacctgccatgccgcttccgcgatgcgtttaataccggagtcggtaaactcgatatttacgccttcagtcgccatcagtgctttgtactgcacggtgatagaggcattcggctcggtcagaatacgctcgaagtcgctggtggtcagcgcctgcagttcaacgcggattggcagacgaccttgcagttccgggatcaggtcagacggtttcgcaatctggaacgcgccagaagcgataaacagaatgtggtcagttttgaccatcccgtgtttggtggaaacggtgcaaccttctaccagcggcagcaggtcacgctgaacgccttcacgagaaacatccggaccggaagactcgccgcgcttacagattttgtcgatttcgtcgataaacacgatcccgtgctgctcaacagcgtcgatagcgtcttgcttcagctcttccgggttcaccagtttcgccgcttcttcttcaatcagcagcttcatggcgtctttgattttcagcttacgcgctttttgcttctggccgcccaggttctggaacatggactgcagctggctggtcatctcttccatgcccggaggagccataatttcaacgcccatcggtgctgcggcaagatcgatctcgatttctttgtcatcaagctggccttcacgcagttttttgcggaatgcctgacgagcagcggacggttcctgctgctgttcggtctgtccccagttgtttttagcaggtgggatcagcacgtcgagaatacgttcttctgccagttcttcagcgcgataacggtttttctcgatagcctggacgcgtaccattttcacggcggcatcggtcagatcgcgaataatagaatccacttccttaccgacgtagcccacttcggtgaatttggtcgcttcaactttgatgaacggcgcattcgccagcttagccagacgacgggcgatttcagttttaccgacaccggtcgggccgatcatcaggatatttttcggggtcacttcatggcgcagctcttcgttgagctgcatgcgacgccagcggttacgcagagcaatcgccacagaacgcttggcgttgtcctggccgatgatgtgcttatccagttcgctgacgatttcgcgtggggtcatttcagacatgggagatccttacgctttgtagcttaattcttcgatggtgtggaaatggttggtatagatgcaaatgtcgcctgcaatatccaacgccttttcagcaatttcacgggcgctaagttcagtgttttctaacagcgcgcgcgccgcagcctgggcgtaagggccgccggagccgatagcaataagatcgttttctggctgcaccacgtcaccgttaccggtgatgataagcgatgcagtttcatccgcgactgccagcagtgcttcaagtttgcgcagcatgcgatcggtacgccagtcttttgccagctcaacggcggctttgaccagatggccctgatgcatttccagtttacgttcaaacagttcgaacagcgtaaaagcatccgcagtaccgcccgcaaagcccgcgatgactttgtcgttgtacagacggcggacctttttcacgttgcctttcattacggtattgcccaacgtggcctgaccatcaccagcgatgaccacatggccgttacggcgtacgcttactatagttgtcacgagctgaccccttggttacgaatacagagtacaaaccccgtacaaaagtacggggcataatgcaattatagatgggggggattttgagggtttcaacccccggcggcgagccgaatgcagtttgtatgacccgccatcttcaaccgattgagggtgctgtctgcgttctctttgcctttcaccgggccaatgaccacacgattccagccattgttggtggtgattttcgagtcaaagccttcgaacgccagctgagcacgtaccgtctctgcctgttccgcgcctctgaacgaaccgcactgcaccatccagcggcgttcgtcttttttctccgccgtcggttttggcgcgtcagcggcacgagcaactggcgcagcttgctgcggcttcgactgcgcagtcgtgtgcgcaggagtttgcagcagatcctggtacggctgctgagaagaagccggtttagactggcgcggttgcgcctgtaccggtgcggcttgcgacgtacgcgtctgctgctgccagctttgttcagtcgtacgcgactgctgagccaggcgttgctgttccgctaattgctgcgcctgacgttggcgctgtagcgtttgctgacgctgttccggcgtctgttcattccacggaacttcaaccagctgcgttggctgctggcgcatatcagcctgcatttgttcaagaagctgacgttgttctggtgtcagttgctccggcgttttcacttcaccaccggcagaaggttctgtgggcgcacgcactcccggctggcgactttccagctctttaatgtagcgccagcgttcttctggttttggtggtagtccgtttccggtcactttctggctttgcagcgtctcggactcttctttcttgtgatgcgtaatgaagtacagaccaccgataaaggtcacaagaacggcggcagcaatagcgaccatagcgggagaaaccgcaggcagatttcgttgctttttccgtgaggtgctcttttttcgccgcgaaggtgccggttggctgcggcgtacataatctcgttgtgccactatcgtttcgctgtatttattcgttcgtcagcccgccatgttacttaagcggcgggcctttgaccagtcacggcagtcttaaaggtttactttaaggtaacgcgcgtgttgatccccggatgataagttcgcagtccattaaacgagagccactgccaacgtgttgcccctgcatttgatcaagcaataacagcatagcttcccgaccgatttcgtaacgcggctgcgcgatggttgtcagcggcggatcacaaaattgcgtcaggtcgatgttatcaaaaccgattatggaaaggtcttccgggactttcagcccctggcgttttgcctgagaaagtgcgccgagcgccatcacatcgctatggcagaagacagcagtaggcggttgtggaagatcaagcagctgctgcatcgctttgcttccggcttcgaaggtgaagtcgccacgggcgatgtattgcggatcaaccataatgccgcagcgacgcagcgcctgaacatagccttgcaggcggtagtgacacagcggcatctcttcgggaccggctatacagccaatccgtttatgcccttgctcatataaataatttactgcatcaaatgcggcggtcagattgtcgatatgaactgtaggcagctccagctccggtgcaaattcgttcgccatcaccatcggcggcagattacgctgttcctcaatgctggcatcaaacggcagccttgaacccagcaacaacatgccatcaatttgcttggtgatgatcaaatcgataaaggttttttcctgctgattttgatgcgcacagtcgccaatcagcaccagatatccgtgatttgccgccgtaacttcgataccgcgaataatttcgctaaagaagggatcgcagatatccgggacaatcaccagaatggtgcgggattcattacgcttgacgttgcgccccataggctgcggtaaataacccacttcccgggccgctttttcaacccgattacgggtggcctgggagactttatcgggattcattaatgctcgggagacggtcgctgtagagacttttgccttgagggcaacgtctttcatggtcgcggcagtttcctgcttcttcgctttcacactcactcctcgcctggcacgtcaggcgtactacatccatgtttacttcacatcggcaacatttttagcagatagcgcgtgaaaacggttacagaattttcatgaaaagtgtgatgaatattgaatttttcgatccgcctcgcatcgtgagcggtttaaccctcaatcggatcaacatccagcacccatttcaccttacgggaatccggtattgtattgatgagcgccagcgtaccgttaatgatgtgttgcaagcgcacgcgggaagggtgctgcaacaatatctgccagcgccagcgaccgccacgtttaggtgccagagccggaaccggaccgagaacccacagtttctcgtctgccagtgggctggagaggatcagattacgcagttgttgcaggaacaatggcgcgtgctgattgttatgatcttccgcacgcacaatcacatggctggtccacggcggtagctgcatcattcgccgctcagccagcgcctgttcggcaaaggcgtcgtagcctttatagagcaacgtttgcaacagaggatgttccggatggtgcgtttgcagcaccacttcgccctgtttacccgcacgcccggcacgaccggcgacctgggtgtaaagctgagcgaaacgctctgccgagcgaaaatcggcagaaaacagcgcgccgtccacgtccagtaatgcaaccagcgtcacatccgggaaatggtgacctttcgccagcatttgtgtaccaatcaaaatccgcgcgccgccgcgatgtacttctgccagttgctgttccagcgcccctttgcggctggtggtatcgcggtcgatacgagaaatgggcacgccggggaacaacggcgcgagcgtctgttcaagctgttcggtgcccagccccacggggaccaggtgcgtggaaccgcaggaagggcactggcgcggcaccggacgctgactgtcacagtggtggcagcgcagatggtgctgcgcctgatgcagcgtgtagtagtgatcgcaacgtgggcattcggcaatccagccacagtcgtggcacagcagtgcaggcgcaaagccacggcggttaagaaagagaatgacctggttatcagcctgtaaatgctggcgcatacgagtgattaacgccggagccagacctgcctgcaccttctgaccttttaaatccagcacatgttgaattgccggacgcgcattccctgcccgacgggtcaggcgcagcaggcggtattttttctgctggacgttgcataacgtttccagcgcgggcgttgcggagccaagaataatcgggatttgctcgctgtgcgcacgatacaccgccaggtcgcgggcatgatagcgccagccttcctgctgcttgtaggagctgtcgtgctcttcatcaatgacaatcacgccgagatttttaaacggcgtaaacagcgcggagcgggtgccgatcacaatcgccgcctcaccatttttcgctttcagccacgccgaaagacgctcgctgtcgttcaggccggaatgcagaacttccacgggggcattaaaacgttcacgaaaacgggcgatagtttgcggtgtcaggccgatttccggcaccatcaccagcgcctgtttgccctgagcgagcacgttttccagtacgctgagataaacctccgttttaccggaaccggtaacgcccgccagcagccaggcagaaaaagtatctgccgcgctatgaattgcgccaacggcggtggcctgttcggtattcaatcgcaaccgctcaccagaaacggcatagttcgttcgccagtcgctaaactctggtgtttcacttgctaaatcacacagaccttttttgcgtagcgcctgcaacgcggcatcattaaattcgagcgtggcgacctggtcgcgccagattttgccttgccgtaacgccgccagcgcctgttgttgcttgggggagcgtttcaggctgttcagatccaccgcctggccttgttcagtggcaaaccagtaccacatcggcgcgttcgccgcaggccgcccctggcgcagtaaaatcggcaaggcatgaaacagcacatcgccaatcggatgatgatagtaatctgccgcccagagcagtaaccgccagacggagtgagtaaataccggctcaacgtccagcacttccactaccgctttcagctcgttaagcggcagctcactgacatcgctaactgacaccacaaccccgatgcgctcctgctgtttgccaaacggcacgcgcacgcgacacccggctttaaccgtcatgccttctggcagcagatagtcaaaggtacgaggaagcggaacgggcaaggcaacgtgggcaacgggcatagcatcatcctgacttgaaattcggtgggttagtatacacattgccgtagaagagtgcggatcagtttgcatacgctggttaatttctgtatgatttcgcgccttcgtacgaaatgatcgtattgaagctatacttttaacatcgcgtggtgtctggcgttagggctggaagagcgacgcggccttaaaccgaggttttcccatgaaaaaagatattcacccgaaatacgaagaaattactgctagctgctcttgcggtaacgtaatgaaaatccgctccaccgttggtcatgacctgaacctcgacgtgtgcagcaagtgccacccattcttcactggcaaacagcgtgatgttgctaccggtggccgtgttgaccgcttcaacaagcgtttcaacatcccgggcagcaaataagaccggatttccgaaaaaagcgccgcacggcgctttttttgtgcctgacaatcgttaaggcattgcgcttatcacactccccgccgtcaattttaaagccggttcaatctctatccccgcgctttgtaacccttttgccgtccatttattacaggtatttaaaatcccatagcgaccattggcggcataaaactggctgtcaccataaatgccttttttgagtggaataacatttcccgcctcgctacgggaaaaactgcggccaataaatagcattaaggtcgcaagttgaccgttgttaattgtcagtggcttaacttcactgccaggaaaatagcgttcaggtggggcagagaacgccaccacatgcattactgcgccagtagaccagaacatcgcctgcaatgtcaggcgactggtaatttcctgtgcctgataaaagcctttatcgccccagccgatttcataccattttggttgcgcaaatctcgcgtcgagttgcggtaaaacacgattaacgattgcggcgggcaccacaattccggtatgccagccgtgactgacaatataaatattatgctgacctgcaaagtcattgtttaccggagcgacagcttgcggaaaggtcgagcaactacaaagcaacaaacagactacggcgggaattatttttttcatcatccattaccacgaaaacagcggccactctttggcgactgtggtgagttgtggcgcgtcgaaaacggcttgtggtgaaactaccgtttcctcaagcggaatatttttgccgtagcgttctttgagcttagcctggaccagcgggttgctgagatcgaactctttcaacttctgctgctcgcccacgcgcattcccagcgcgttctggtaaaccttccacaccacttccgaacagtactggcgatcgtcgctccatgagaagctgaaatcatacggtttaccgagataacgttttgccgtttgcgccagtttttgctgttgttcaacactcagtccgccttcaacgcggcgaacaacgtatttgcccttttcaccatgggcgatccactgcttgagcggggtgtatttcaccgggccgaccgcttcaaaaacgtagggctttttgttgcgtatcaccagcataccggtgtggctataatcggaatgggtcgccagttggatcgctttactttgcgatgagcgagagatctgaaagatgatgtcgccggtttgtggctgccaggcaaaggcaggtacagaaaccagcaggctgaggatcagcagcctgtttttcatagttaaacgtccatgtataaaaagcggtgggtcgcagacaacgtgctcgttgtttatgccggatgcggcgtgaacgccttatccggcctacaagttcgtgcaaattcaataaattgcaatatgacgtaggcctgataagcgtagcgcatcaggcgattccactccgcgccgctcttttttgctttagtattcccacgtctccgggttaatccccatctcacgcatgatctcttttgccgcttccgggatttcgtcgctgcgctctttacgcagatcggcatcatccggcaaaggttgcccggtaaaggcatgcagaaacgcttcgcacagcagctcgctgttggtagcgtgacgcaggttgttcacctgacgacgcgtgcgttcatcggtgaggatttttaacaccttaagaggaatggaaaccgtaatctttttgacttgttcactcttcttgccgtgctcagcgtatgggctgatatattcgccgctccattcagccatgagatacttaatcctcttcgtcaataaattgagaccagaccacacagttgatgtgggtactgaccgtaaacccgcatagtttaccgtacaggcgttaccgtgacatcgtgtaatgcacctgtcggcgtgataatgcatataattttaacggctatttgggatttgctcaatctatacgcaaagaagtttagatgtccagatgtattgacgtccattaacacaatgtttactctggtgcctgacatttcaccgacaaagcccagggaacttcatcacatgacgcgtaaacaggccaccatcgcagtgcgtagcgggttaaatgacgacgaacagtatggttgcgttgtcccaccgatccatctttccagcacctataactttaccggatttaatgaaccgcgcgcgcatgattactcgcgtcgcggcaacccaacgcgcgatgtggttcagcgtgcgctggcagaactggaaggtggtgccggtgcagtgctcaccaataccggcatgtcagccatccatctggtaaccaccgtctttttgaaacctggcgatttgctggttgcgccgcacgactgctacggcggtagctatcgcctgttcgacagcctggcgaaacgtggttgctatcgcgtgttgtttgttgatcaaggcgatgaacaggcattacgggcagcgctggcagaaaaacccaaactggtactggtagaaagcccaagtaatccattgttacgcgtcgtggatattgcgaaaatctgccatctggcaagggaagtcggggcggtgagcgtggtggataacaccttcttaagcccggcattacaaaatccgctggcattaggtgccgatctggtgttgcattcatgcacgaaatatctgaacggtcactcagacgtagtggccggcgtggtgattgctaaagacccggacgttgtcactgaactggcctggtgggcaaacaatattggcgtgacgggcggcgcgtttgacagctatctgctgctacgtgggttgcgaacgctggtgccgcgtatggagctggcgcagcgtaacgcgcaggcgattgtgaaatatctgcaaacccagccgttggtgaaaaaactgtatcacccgtcgctgccggaaaatcaggggcatgaaattgccgcgcgccagcaaaaaggctttggcgcaatgttgagttttgaactggatggcgatgagcagacgctgcgtcgtttcctgggcgggctgtcgttgtttacgctggcggaatcattagggggagtggaaagtttaatctctcacgccgcaaccatgacacatgcaggcatggcaccagaagcgcgtgctgccgccgggatctccgagacgctgctgcgtatctccaccggtattgaagatggcgaagatttaattgccgacctggaaaatggcttccgggctgcaaacaaggggtaaaaatgagtgtgattgcgcaggcaggggcgaaaggtcgtcagctgcataaatttggtggcagtagtctggctgatgtgaagtgttatttgcgtgtcgcgggcattatggcggagtactctcagcctgacgatatgatggtggtttccgccgccggtagcaccactaaccagttgattaactggttgaaactaagccagaccgatcgtctctctgcgcatcaggttcaacaaacgctgcgtcgctatcagtgcgatctgattagcggtctgctacccgctgaagaagccgatagcctcattagcgcttttgtcagcgatctggaacgcctggcggcgttgctcgacagtggtattaacgatgcggtgtatgcggaagtggtgggccacggtgaagtgtggtcggcgcgcctgatgtctgcggtacttaatcaacaagggctgccagcggcctggcttgatgcccgcgagtttttacgcgctgaacgcgccgcacaaccgcaggttgatgaagggctttcttacccgttgctgcaacagctgctggtgcaacatccgggcaaacgtctggtggtgaccggatttatcagccgcaacaacgccggtgaaacggtgctgctggggcgtaacggttccgactattccgcgacacaaatcggtgcgctggcgggtgtttctcgcgtaaccatctggagcgacgtcgccggggtatacagtgccgacccgcgtaaagtgaaagatgcctgcctgctgccgttgctgcgtctggatgaggccagcgaactggcgcgcctggcggctcccgttcttcacgcccgtactttacagccggtttctggcagcgaaatcgacctgcaactgcgctgtagctacacgccggatcaaggttccacgcgcattgaacgcgtgctggcctccggtactggtgcgcgtattgtcaccagccacgatgatgtctgtttgattgagtttcaggtgcccgccagtcaggatttcaaactggcgcataaagagatcgaccaaatcctgaaacgcgcgcaggtacgcccgctggcggttggcgtacataacgatcgccagttgctgcaattttgctacacctcagaagtggccgacagtgcgctgaaaatcctcgacgaagcgggattacctggcgaactgcgcctgcgtcaggggctggcgctggtggcgatggtcggtgcaggcgtcacccgtaacccgctgcattgccaccgcttctggcagcaactgaaaggccagccggtcgaatttacctggcagtccgatgacggcatcagcctggtggcagtactgcgcaccggcccgaccgaaagcctgattcaggggctgcatcagtccgtcttccgcgcagaaaaacgcatcggcctggtattgttcggtaagggcaatatcggttcccgttggctggaactgttcgcccgtgagcagagcacgctttcggcacgtaccggctttgagtttgtgctggcaggtgtggtggacagccgccgcagcctgttgagctatgacgggctggacgccagccgcgcgttagccttcttcaacgatgaagcggttgagcaggatgaagagtcgttgttcctgtggatgcgcgcccatccgtatgatgatttagtggtgctggacgttaccgccagccagcagcttgctgatcagtatcttgatttcgccagccacggtttccacgttatcagcgccaacaaactggcgggagccagcgacagcaataaatatcgccagatccacgacgccttcgaaaaaaccgggcgtcactggctgtacaatgccaccgtcggtgcgggcttgccgatcaaccacaccgtgcgcgatctgatcgacagcggcgatactattttgtcgatcagcgggatcttctccggcacgctctcctggctgttcctgcaattcgacggtagcgtgccgtttaccgagctggtggatcaggcgtggcagcagggcttaaccgaacctgacccgcgtgacgatctctctggcaaagacgtgatgcgcaagctggtgattctggcgcgtgaagcaggttacaacatcgaaccggatcaggtacgtgtggaatcgctggtgcctgctcattgcgaaggcggcagcatcgaccatttctttgaaaatggcgatgaactgaacgagcagatggtgcaacggctggaagcggcccgcgaaatggggctggtgctgcgctacgtggcgcgtttcgatgccaacggtaaagcgcgtgtaggcgtggaagcggtgcgtgaagatcatccgttggcatcactgctgccgtgcgataacgtctttgccatcgaaagccgctggtatcgcgataaccctctggtgatccgcggacctggcgctgggcgcgacgtcaccgccggggcgattcagtcggatatcaaccggctggcacagttgttgtaatttcagaaatttaataatgcccggtactcatgttttcgggtttatggtttctaatgaaatgtattgaattatcataggattaggccggattaagcgtttacgacgaatccggcaagaagcaataagtacatggttagtttatatttgcagtccggtttgctttgcataccggattttctttttcttaccatcctgaagttttttcatcttccctgatttttcctcaccatcattggtcatttttcggttgacgcccttcggcttttccttcatctttacatctggacgtctaaacggatagatgtgcacaacacaacatataactacaagcgattgatgaggtaaggtatgagcttttttcacgccagccagcgggatgccctgaatcagagcctggcagaagtccaggggcagattaacgtttcgttcgagtttttcccgccgcgtaccagtgaaatggagcagaccctgtggaactccatcgatcgccttagcagcctgaaaccgaagtttgtatcggtgacctatggcgcgaactccggcgagcgcgaccgtacgcacagcattattaaaggcattaaagatcgcactggtctggaagcggcaccgcatcttacttgcattgatgcgacgcccgacgagctgcgcaccattgcacgcgactactggaataacggtattcgtcatatcgtggcgctgcgtggcgatctgccgccgggaagtggtaagccagaaatgtatgcttctgacctggtgacgctattaaaagaagtggcagatttcgatatctccgtggcggcgtatccggaagttcacccggaagcaaaaagcgctcaggcggatttgcttaatctgaaacgcaaagtggatgccggagccaaccgcgcgattactcagttcttcttcgatgtcgaaagctacctgcgttttcgtgaccgctgtgtatcggcgggcattgatgtggaaattattccgggaattttgccggtatctaactttaaacaggcgaagaaatttgccgatatgaccaacgtgcgtattccggcgtggatggcgcaaatgttcgacggtctggatgatgatgccgaaacccgcaaactggttggcgcgaatattgccatggatatggtgaagattttaagccgtgaaggagtgaaagatttccacttctatacgcttaaccgtgctgaaatgagttacgcgatttgccatacgctgggggttcgacctggtttataaatagtgtggcttttgtgaaaatcacacagtgatcacaaattttaaacagagcacaaaatgctgcctcgaaatgagggcgggaaaataaggttatcagccttgttttctccctcattacttgaaggatatgaagctaaaacccttttttataaagcatttgtccgaattcggacataatcaaaaaagcttaattaagatcaatttgatctacatctctttaaccaacaatatgtaagatctcaactatcgcatccgtggattaattcaattataacttctctctaacgctgtgtatcgtaacggtaacactgtagaggggagcacattgatgagcacgtcagacgatatccataacaccacagccactggcaaatgcccgttccatcagggcggtcacgaccagagtgcgggggcgggcacaaccactcgcgactggtggccaaatcaacttcgtgttgacctgttaaaccaacattctaatcgttctaacccactgggtgaggactttgactaccgcaaagaattcagcaaattagattactacggcctgaaaaaagatctgaaagccctgttgacagaatctcaaccgtggtggccagccgactggggcagttacgccggtctgtttattcgtatggcctggcacggcgcggggacttaccgttcaatcgatggacgcggtggcgcgggtcgtggtcagcaacgttttgcaccgctgaactcctggccggataacgtaagcctcgataaagcgcgtcgcctgttgtggccaatcaaacagaaatatggtcagaaaatctcctgggccgacctgtttatcctcgcgggtaacgtggcgctagaaaactccggcttccgtaccttcggttttggtgccggtcgtgaagacgtctgggaaccggatctggatgttaactggggtgatgaaaaagcctggctgactcaccgtcatccggaagcgctggcgaaagcaccgctgggtgcaaccgagatgggtctgatttacgttaacccggaaggcccggatcacagcggcgaaccgctttctgcggcagcagctatccgcgcgaccttcggcaacatgggcatgaacgacgaagaaaccgtggcgctgattgcgggtggtcatacgctgggtaaaacccacggtgccggtccgacatcaaatgtaggtcctgatccagaagctgcaccgattgaagaacaaggtttaggttgggcgagcacttacggcagcggcgttggcgcagatgccattacctctggtctggaagtagtctggacccagacgccgacccagtggagcaactatttcttcgagaacctgttcaagtatgagtgggtacagacccgcagcccggctggcgcaatccagttcgaagcggtagacgcaccggaaattatcccggatccgtttgatccgtcgaagaaacgtaaaccgacaatgctggtgaccgacctgacgctgcgttttgatcctgagttcgagaagatctctcgtcgtttcctcaacgatccgcaggcgttcaacgaagcctttgcccgtgcctggttcaaactgacgcacagggatatggggccgaaatctcgctacatcgggccggaagtgccgaaagaagatctgatctggcaagatccgctgccgcagccgatctacaacccgaccgagcaggacattatcgatctgaaattcgcgattgcggattctggtctgtctgttagtgagctggtatcggtggcctgggcatctgcttctaccttccgtggtggcgacaaacgcggtggtgccaacggtgcgcgtctggcattaatgccgcagcgcgactgggatgtgaacgccgcagccgttcgtgctctgcctgttctggagaaaatccagaaagagtctggtaaagcctcgctggcggatatcatagtgctggctggtgtggttggtgttgagaaagccgcaagcgccgcaggtttgagcattcatgtaccgtttgcgccgggtcgcgttgatgcgcgtcaggatcagactgacattgagatgtttgagctgctggagccaattgctgacggtttccgtaactatcgcgctcgtctggacgtttccaccaccgagtcactgctgatcgacaaagcacagcaactgacgctgaccgcgccggaaatgactgcgctggtgggcggcatgcgtgtactgggtgccaacttcgatggcagcaaaaacggcgtcttcactgaccgcgttggcgtattgagcaatgacttcttcgtgaacttgctggatatgcgttacgagtggaaagcgaccgacgaatcgaaagagctgttcgaaggccgtgaccgtgaaaccggcgaagtgaaatttacggccagccgtgcggatctggtttttggttctaactccgtcctgcgtgcggtggcggaagtttacgccagtagcgatgcccacgagaagtttgttaaagacttcgtggcggcatgggtgaaagtgatgaacctcgaccgtttcgacctgctgtaatctgaccccgttcagcggctgcttgctggcagtcgctgaacgttctttaccagcgtatagtgggcgaacgaaaactacacactggatctctcatgtctgccgcaggaaagagcaacccactggcaatcagtggcctggttgtgctcacacttatctggagttatagctggattttcatgaagcaagtcaccagttacatcggtgccttcgactttaccgccttacgctgcattttcggcgctctcgttttattcatcgtccttttattacgtggtcgcggaatgcgcccgacaccgtttaaatacaccttagccattgccctgttacaaacctgcgggatggttggtctggcgcagtgggcgttggtcagcggaggtgcggggaaggtggcgatcctgagctataccatgccgttctgggtggtgattttcgccgcgttgtttctcggtgaacgcctgcgacgtgggcaatatttcgcgattctgattgccgctttcggcttatttttggtgttgcagccgtggcaactcgatttctcttcgatgaaaagtgccatgctggcaatcctctccggcgtcagttggggggcgagcgcgattgttgctaaacgtctgtatgcccgtcatccgcgcgtggatttattgtcgttaacatcctggcagatgctgtatgcggcgctggtgatgagtgtggtcgctttactggtgccgcaacgtgaaattgactggcagcccaccgtgttctgggcgctggcctacagtgcgattctggcgacggcactggcgtggagcttatggttgtttgtattgaaaaacttgcctgccagtattgccagcttaagcacactggccgttcccgtttgcggcgtactcttttcctggtggctgctcggcgagaatccgggggccgttgaaggtagcggtattgtgctgattgtgctggcactggcgctggtgagccgtaagaaaaaagaagccgtcagtgtaaaaaggatctgaattttttcttcatgtggggcgatctcttatttaacaaaataacgataatgccccaccatccgccagttaaacagcacatcttcttcctgcgcgcctgcgccaatgttatgtatcaccagcggcgtaccgtcgcgggcgaagccatctgaaaccaccccaatatgtgccagcccgttatccagtcgccaggagacaatatcgcccgcttgatagtcactggggttcttgctggtggggcgtgttttatcatggcggctaaaccaggtttccagattaggcacccgacggtgatcgatgttgctgtccgggcgctttaacttccatttttgcgggtactcagcaaaattcttcgccatatcttcgtgaaccagtttctgcaaatcgaccttctggctgcgcaatgcgcggatcaccacatcggaacatacaccgcgttcttgcggaacatcaccgccaggataagtaagctgcacatacgccggatcgtaaaatagcgtgctgccaatttgctgtctggcaccgtctgcgatggcaaggttggtattggcctggatttgtaccacggttggtggaacggcgggagattttaaggagtggctggtaaatgccgttagcaggctgagcagcgccagtgaagctttcatctggttcgtccgtgaaaataagagtcacagattcgaccttccgggctaacgattgttctgtagagaaaatgtccagaagcggataaaaaattcctgaacaacgtgggagtttcagattactggcacagagtgccggatgcggagtgaacgccttatccggcctacaaaagcacgcaaattcaatatattgcagagattgcgtagatactgttatggcctgcaagttttttcctggtccggtttcccggattgcaggcatgccagacacagcgccgtcaggcgctgtttttttcatcccttccgcgatttttacgccgctaccggattatgccgtgacgcatcgaacggcacgcctgacttcagcactccatacgccacctgtgccagcttgcgcatcatcgcgccgagaatcacctttcctttcttgccattagccgccagacggtcgcggaacgcccgtccccactcagtcttactggtggctaccattgcgggcatatacaacgccctgcgaagcgacacatgtccggccttactcatccggctcgcccctctcacactgctacctgattcataacgccgtggtgtcagacccgcaaaagcggcgaactgtctggcatgggcgaagcggtccttcagaccgatataagccagcaataccgcagatgttttctctccgatacccgggatgctttccagcagtttcctgcggtgtttcatatccggatcatcgtctgtcaggtcttttatctgcttctcaagacgcttcagctctgcttcaagccacagaaggtgagcatcaatgctcggtctctggacttcccgcgccgtttcagtgcgattcagttcctgcgtgtgcatatctgtcagcgcctggtggcggactaccagggcacgcaacgcgcgttcaagcgggtgaggcgcttcccaggctgcagggcgcttctgacgacagaactctgccagcatgcgcgcatccacggtatcagtcttgttacgcagtccttcactctgagcgaaagctttacccagcgcaggattaatgactgacactatgtagccagcatcgtaaaggcactcagcgacaggttccatataggtgccggtcgcttcgatgcagatatgcgcatggtcaatcttgtgacctttcagccagctcaccagctcatcgtgccctttagtggtgttagcgaattttttggtgcgatgacgaccatcaggacgcaacacatcgacatccagtttctctttagcggtgtcgataccgatataatgaagttcatgttccatagtgaaaccaaccttgcaaatacggattaccgggaaaaccggtccatgatactgtccggtttatcactttgggagaaaggcagtccgctgcataaatctacgcaacaggttagaacccaaggcccgatacggcatgcggactgcaggcagagaaaactggccgattttctctgcactggagggataatacaaggcctgataagcgtagcgcatcaggcaattttgcgttcaaactcccggacaagccgggagtttggagtaggttattcccactcttgcaggaaacgctgaccgtactggtcggctaccagcagagcggcgtaaacctgatctggcgtcgcgccgccaggcatgttgtggatggtttcaccttctgcacatgccgcttctgccacaattcgcattttcgccgggacatcttctttaatatccagttgagcgagagttattggcaaacctaccgcatggctaagtgcagctacggtttcgatttcctcaaccggtgcgttttccagaaccagctgcgtcagcgtaccaaatgccactttttcaccgtgataatagtgatgcgcgtccgggatagcggtcaggccgttatgcactgcgtgcgccgcagccagaccaccactttcaaagcctacaccgcttaaataggtgttcgcttcaatcacgcgctccagcgccggagtcactacatgctgttcggcagcaagcatcgctttttcgccttcttccagcagagtgttgtagcacagttctgccagtgccagcgccgcctgggtacacttgccgcccgccatagtggtagcgccgctacgggaacaggcgcgtgcttcaaaccaggttgccagcgcatcgccgatacccgccgctaacagacgtgcaggtgcgccagcgacgattttggtgtcgacaatgaccatattcgggttatttggcaacagcagatagcggtcaaactcaccctcatcggtgtagataacagacaatgcgctgcacggtgcatcggtagaggcgatagtcggtgcgatcgctaccggaacacccatgaaatgtgccagtgctttggcagtatcgagggtttttccgccaccgataccgagaattgcgccacactgcgcagtctccgcgatgccacgcagacggtcgatctcattttgcgaacattcaccgccaaacggcgcaatttctactaccagtccagcatctttaaagcttttctcgacagtggattgagcaaaacctaaaacaaatttgtcacccaccactaaccagcgttctgccagcggcttcaggtattcgcccagacgattaatcacatcagcgccctggatgtatttacccggtgattgaataatgcggtccataattgctcctttagagatgagtagtgccaaatgcggcattccagtcgtgttcgaacttctctatagctgactctaccgcaggggtgttgagcatttgttgcgctacatctaagggcagggtgatggattcacatcctgccagtaaacagtccagcgcctgacgcggcgttttaaagctggccgccagcaccatgctttctggcgcgtgcatttctaacagcgtttgcagctcctgaaccgtacgaatgccgtccccgccctgggcatctacgcggttaacatacggagcaacgtattttgcccctgccagtgcggctaataacccttgtgcggcgctatatacagcggtgccaagtgtagtaataccctcttttttcagcaacttaatggcggccagaccttcggaagtcaccgggattttcaccacaatgcccggaatggcgtcgcgcaggcgcttcgcttcttccaccataccctgcgcgtcacgactcatagtctgagcaaacagaatgccctcatcaccaatcgctttttgcagacgcggcagcacttcccagatggactccttgctggcagcgataatgctcgggttagttgtcaccccggcaatggggaatatgcgtgccagacgttcgacttctgcgacgttagcggtgtccagatacagttccatgatgtttccttttacagttccagttcatgttgcagcaggctggcgatagcgtcggcagaggcggcgttaaccagcgcgttacggaattcttcgtgcatgatgcggcgagcgaggcgcgagaaaatgcgcatatgctgatcgcccgcagcgtgtttgttcagggttaacataatgatgaattgcgcttcatcatcgccccagcgcaccggcgcttgcagacgcgctacgctgatggtggattgctcaatgtgttctgatttgctgtggggaatggcaaaactaaagcccagaccggtagagaaaacggcctcgcgcgcccataagtcggcttccagtttacgcggatagcggcagcggcccgccagcagcaggttatcggtcatgcctttgagcacttcttctttgctgcgccagtcactttccagcgtgatgcactcggcggtgaccagcggtgcgtcctgttgggtcatgcggaattgcgccagcagatgttccacttccagcgaagtacggcaggccattgcctggttgagcaactggcggcactcacggctatcaagttgcgccattcgcgctttcgccgccggaattgacggtgcgctcatgctgagttcatccagccctaaaccgaccagcaacggcagcacggaacctttcgctcccagctcaccgcacagaccaatccatttgccctggcgatgcaccgcctgcacggcgtaatcgagcgcccgcaagaatgccggattcaggctgttgtagtgacgagtaaccttagcgttatcgcgatccaccgccagcagatattgcgtcaggtcattactaccaatactaaagaaatcaatctcttcgcagcattgatcgatgatgaacatcaccgacggcacttccagcataatgccgagctggatcttctcatcaaacggaatgtgttcgttacgcagttgctgtttggcttccgccagtttttctttcacccataagatctcttccattgaggagatcatcgggatcatgattttcaggctgccgtgagcagaggcgcgcaggattgaccgtagttgtgtggtaaacaacgacgcgtattcttcataaatacgcaccgcgcgataaccgaggaacgggttagcttctgccggaatgttcagataatcaacgggtttatcaccgccaatgtccatagtgcgcacaataatgctgcgtccgttggcagactccagcgcctgacaaaaaatgttgtacagctcgctttcacccggtgcactggtgcgatccatatagagcatttcagtgcggaacaaaccaacgccttccgcaccattgccgaatgcggcctgcgcttccacggagtgagcgatgttagcggcaatttcaatacggataccgtcagcggtacgggcttgttgggtcagccagacacgctgttgctcacgaagggcgtcctgtacgcgggcttcttgctgataataacgagctacggcttcccctggctcaaccacaatcgccccagcgttgccgtcgatataaatcgtttgatgctgccacggagtgagggcatcaatatccacaccaaccagtgtcggaatgttgaacgaacgggcaagaattacggtatgtgaggtggtgccgccacttttcagtaacagacctttgaggtgatttttatccagttcgaggaactggctgggagtcagttcatcagccatacaaatggcgggctgcgtcagtttgcccggtgccgggaagcgttgctcaccgtagatttgctggagtaactggaagcagacgtcgcgtacgtccagggcacgttcttgcaggtagctgctgctggaacgggcgaactcttcgcaaaagtgattcgcactggcgacaatcgcttcggcgcagcttaatccggcgctgacgcctgccagtaaatgttcgcgcagggaagtatcgccagccagggatcggtgcgcttccagaatcgcgctggtagcaccgtcgctatccagcagacgaaactcaatgtttttcagtaccagcgtcaggccgttttccagtgcggattgttcggcgtcaacgcctttggcagcgggaagattactcagcgcattgagatctaaagaagagatcggcgtcagaatgccgcctgcgctaccgctgcacacggtgcgggcgcggataatttgcggattcagattggtcaatgaaaccggcagtggttccagttcgtcagatttaacttccgccagcggcgcatcgcagtgggggaattcatcgcgcagccattggcttaaacgctggtgcgcttcctgttcgtcggccccggaaatcagtaactggcaattatcgcccaccagcgtgtcggtgccaatcagcgccagggcgcttttggcgttgcctttacggtcagtgcgcaggttatgccactcaatttgtgatgaaaaagtattacacagcgtttcaacgtggcttgccggacgtgcatgtacgccgttaggtagctcacaaataaattccacaatcagggccattgcctctctcccggtacggttttctgtttacaggataagagcgcacggcaacggcctgccatgtgacaaatctgccaaaagctggacaaatgtaatgtaaccgtcaatttgcgacgcgtctcacaagacgccgttttgcggcatgcttccggattatcgcaagttatgaggcggatcgcatttttgtactgatattacaaaagtccagtaaatggcctttttatccactgtttgctccgcctgcgattgcctattgtttcctccatcaaaaatatggacatgggcttttgcaagcccgggagcagcttatgaatgagttggtgcagatcctgaaaaatacccgtcagcatttaatgacgggcgtttcacacatgattcccttcgtggtatcgggcggtattttgctggcggtttccgtcatgttgtatggcaaaggcgcagtgccggatgccgtagccgatccgaatctgaaaaaactgtttgatatcggcgttgcgggtttgacgctgatggtgcctttcctcgccgcttacattggttactccattgcagagcgttctgcgctggctccgtgcgctatcggggcctgggttggtaacagctttggtgcgggcttctttggtgcgctgatcgccgggattatcggcggcatcgtggtgcattacctgaagaaaattccggtgcataaagttctgcgctcggtgatgcctatcttcatcattcctatcgtcggcacactgattaccgcaggcatcatgatgtggggcttgggcgagcctgtaggggcgttgaccaacagcctgactcagtggcttcaggggatgcagcagggcagcattgttatgctggcggtgatcatgggtctgatgctggcgttcgatatgggcggtccggttaacaaagtggcctatgccttcatgctgatttgcgttgctcagggtgtttataccgtggtggctattgccgctgttgggatttgtgttccaccgctggggatggggctggcgacgctgattggtcgtaaaaatttctccgcagaagagcgcgaaactggtaaagcggcgctggtgatggggtgcgttggggttactgaaggggcgattcctttcgccgctgccgatccgctgcgtgtcattccttccatcatggttggttctgtttgtggtgcggtaactgcggcgctggtcggtgcgcagtgctatgcaggctggggtggtctgattgtactgccggtggttgaaggcaagctgggttatatcgccgcagtggctgtcggagcagtggtgacggctgtttgtgtgaacgtgctgaaaagtctggcgcgtaaaaatgggtcttcgactgatgaaaaagaagacgacctggatttggattttgaaattaattaattgaggaacaagccatgacgaaaattattgcagtaaccgcatgtccttcaggtgttgcccatacctatatggcagcagaagcgctggaaagtgccgcgaaagcgaaaggctgggaagtgaaagtagaaacccagggctcaattggtctggaaaatgaactgactgcggaagacgtggcgagcgccgatatggtgattctgactaaagatatcggcatcaagtttgaagagcgttttgctggcaagaccatcgtgcgcgtcaacatcagcgatgcggtaaaacgtgctgatgccattatgagcaaaattgaagctcacctggcgcaaaccgcttaagttcttatcccgcccgtaagggcgggttcgctttcccacaggagttcctcatgacgaatcgtatctctcgcctcaaaactgcactgtttgccaatacccgtgaaatctcgctggagcgggcgctgctttataccgccagccatcggcaaaccgaaggcgaaccggtgatattgcgccgggcgaaagcaacagcgtatatccttgaacatgttgaaatttcgattcgtgatgaagaactgattgccggtaaccgcaccgtaaaaccgcgcgccgggattatgtcgccggaaatggacccttactggctgctgaaagagctggatcaattcccgacgcgtccgcaggaccgctttgctatcagcgaagaagataaacgtatctaccgcgaagagttgttcccgtactgggaaaaacgttcgatgaaagatttcatcaacgggcagatgacagatgaagtaaaagccgcgaccagcacgcagattttcagcatcaaccagacagataaaggccaggggcacattattattgattacccacgcctgctgaatcacgggctgggggagctggtagcacagatgcagcaacattgtcagcaacagccggagaatcacttttatcaggcagcgctgttactgctggaagcctcgcagaaacacattttgcgttacgccgaactggcggaaacgatggcggcaaactgcacagatgcccagcgtcgcgaagagctgctgactattgcggagatctcccgccataacgcgcaacataagccgcagacgttctggcaggcgtgccagttattctggtacatgaacatcattctgcaatacgaatccaacgccagttcgctatcgttggggcgcttcgaccagtatatgttgccgttctatcagacatcattaacccagggcgaagatgcggcgttcctgaaagaactgctcgaatctttatgggtgaaatgcaacgacatcgtgctgttgcgctccaccagcagcgcgcgttatttcgccggtttcccgaccggctataccgcactgctcggcgggttaaccgagaacggacgtagcgcggtgaacgtgctttcgttcctttgccttgacgcctatcaaagcgtgcaattaccgcaaccgaacctcggcgtgcgcactaacgccttgatcgacacgccgttcctgatgaaaaccgccgaaaccattcgcctcggcaccggtattccgcaaatctttaacgatgaagtggtggtgccagcgttcctcaaccgtggcgtttcgctggaagatgcgcgcgactattccgtagtgggctgtgtggaattatctattcccggcagaacctacggcttgcatgacatcgcgatgtttaacctgctgaaagtgatggaaatctgcctgcatgaaaatgaaggcaatgccgcgctgacttatgaaggtttactggaacagatccgtgccaagatcagccactacatcaccctgatggttgaaggcagtaatatttgcgatatcggccatcgcgactgggcacctgtaccgctgctctcgtcttttatcagcgattgtctggaaaaaggccgcgatattaccgatggcggcgcgcgttataacttctccggcgtacaggggatcggtatcgccaacctgagcgattctctccatgcgttgaaagggatggtttttgatcaacagcgtttaagttttgacgaattgctgtcggtattaaaagccaactttgcaacgccagaaggcgaaaaagtccgcgctcgcttaattaaccgctttgagaaatacggtaacgatatcgacgaggtggataacattagcgccgaactgttgcgccactactgcaaagaagtggaaaaataccagaacccgcgcggcggctacttcacgccgggatcgtataccgtttctgctcacgttccgttgggatcggtggttggcgcgacgccagacggtcgttttgccggagaacagctggcagacggcggcttgtcacctatgctgggtcaggacgcacaagggccaacggcggtactgaagtcagtcagtaagctcgataacacactgctgtctaacggtacattgctgaacgtgaaattcactccggcgaccctggaaggtgaagcgggattacgcaaactggccgacttcttacgggcgtttacccagcttaagttacaacatattcagtttaacgtggtgaacgccgacacgttgcgggaagcgcaacagcgcccacaagattatgccgggctggtggtgcgcgttgccggatacagcgccttctttgtcgaactgtcgaaggagatccaggatgacatcatccgccggacagcgcatcagctgtaacgttgtggaaacgcgccgcaatgatgtggcgcgcattttcaacattcagcgttattcactgaatgacggtgagggcattcgtacggtggtcttttttaaaggctgtccgcatctttgcccgtggtgtgctaatccggagtcgatctccggcaaaatccagacggtacgcagagaggcgaaatgtctgcactgtgcgaaatgtttgcgtgatgcggatgaatgcccctccggggcgtttgaacggattggtcgcgatatcagccttgacgctctggaacgggaagtgatgaaagatgacattttttttcgcacgtccggcggcggcgtcacgctttctggcggcgaagtgttaatgcaggcggagtttgctacccgttttttacagcgactgcggctgtggggtgtgtcatgcgccattgaaactgccggagacgcgccagcaagcaagctgttaccgctggcgaaattgtgcgatgaagtgctgttcgatttaaaaattatggacgcgactcaggcgcgggatgtggtgaagatgaacctgccacgcgtgctggagaatctgcgtttgctggtgagtgagggtgtcaacgtgatcccgcgtttaccgttgatccctggtttcacgctcagccgggagaatatgcagcaggcgctggatgtactgatcccgctgaaaatcaggcagatccatctgttaccgtttcatcagtacggcgaaccgaaataccgcctgctggggaaaacatggtcgatgaaagaggtgcctgcgccgtcgtcagccgatgtgacaacgatgcgcgaaatggcagaacgggccggatttcaggttaccgtgggaggttaaaatggcatacctggtggcagtaaccgcctgcgtcagtggcgtggcgcatacttatatggcggcggaacggctggaaaagttgtgcctgttagagaagtggggagtcagcattgaaactcagggcgcgctgggaacggagaatcgtttagcggacgaggatatccgtcgggcggatgttgctctgttgattacggatatcgagcttgccggtgccgagcgatttgaacattgccgctatgtgcaatgcagcatctacgcattcctgcgtgagccgcagcgggtaatgagcgcggtgcgcaaagtgctttctgcgccgcagcaaacccatcttattctggagtagtcggtttttctgtcagttggctgtggtactgccgacgatattccgacggcgagcgttctgtgtttttacgaaacagacggcagaagtagttgctgtcgacaaagccgcaggcgtgcgccacttcttttaccttcaggtcatagcctttcaataacgtcttagcgtgctccagtcgcgtgtgattcaggtattcgttaaaaccaatggcccccgttttttgaaacaggtgcgagaggtaatttggcgaaatataaaacgcctgcgcaacagattcgcgggtaagcgcggaggcatagcgttcgtcgatataatcgcgaatagcttcaaatagtgcctggctgcgtgaggcggtctggatttggctgccaagcaaatcgcggcagtggctaagcaggctggcgacgataagccttgccgtttgctgctcctgcggctgcatttgcatttcattgagcgtttgtagcagaaaagaacctatgcgtgggccgcgccgggcgacgtgttgcttcgccagattttgatattgtttgccatcccattgcacgacgctgaagccgagttgctgtttgccaaacagcacgctaaaggtggtagcgggtgttttccattgtgggaaattccagccaccagcggcaacgtacagcacatcgccgggaactaacgttgctccagcgccggtatcaacaaactcaccttccagcacaatttccagccgtggaaaatcgacctgatacgcaagatcgggcaccgggccgttactgctggcaaagtaaatctggcgcagggacagcgggccgttgatcaggcgggagagcagatagctgacgtcgtgatacatgttattcccttaggtatgtagacgggaaaacagtaactggcattattaaaaaaggccacctgaaaagtgtggcctgaggggagttcgatgtaaacattgcggcagttgtattgccggatgtggcgtaaacgccttatccagcctaccgccgcgatctgtaggccggataagacgcgtcaagcgtcgcatccggcaaatagcgcctggctgataattactgattacccacctgatcgccatacggcagtgtgtcgtaatcgatcagcgcgtttttcttgtacgggttaccaatccagcgggtagtttctttgaactgcggattcaccactgaacgggttggatcgtaaccgtcgtaagataagcccgccaaatctgaccaggtgtggatcagttccgccaggctgtatttacgatcgacatcctgtgagaaatcacggggatgagtcgcttgccatttttccgacgtccacagcaggaacggaatggtgtacatatgacgcgtcgggttgtcctcattacgcccctgggttttatgaggcggcgtgtcgtaaacctcttcaccgtggtcagagaagtaaaccaggaatccgttcgggtctgccgctttaaagtctttaatcaggctggcaaccacatgatcgttatacaggttagcgttgtcataatcgttatatgattccagctcttctgcgcttaatcctggcggaacatgatcggtattgccatcaaacttgccctgattttccgggtagcggtatttgtatttgatatgcgtacccagcagatgaacgatgatcagtttcttcggcgcagggtcattcagcacatcctggaacggcttcagcacgttggtgtcgtattcacgcgcactctgcgtacgttgctggttcatgtagtactgcttgtcggtctggcgcgaaaataccgtcagcatggtattgcgggcggtcatcgtctgctggttggtgatccagaaggttttataacccgcctgtttcatcatgttcatcagcgacggctgcgtcagatacaggtccgggttcttttcattggcaaaggtcagcgcctgttgcaggatttcaatggtgtacggacgagacgtaaccacgttattaaacacggtcagattcggatcggttttatgcagcgcatccagctccggcgtggtttcacgcggataaccgtacagactcatgcgtccacgctgggttgactcgccaatcaccagcactaaggtgcgcggttcgttacccgattcatctttgaaattagccagcggcggcaaggcattattttcattcagtagctttgttagcgagtttagttgctgacgatactgataatagccggtcaggaattgccacggtgcggcaggctccatacgcgaggccaggttatccaacgttttctcaaacggcttgtttttgataaacgtattcatggcgatcggatgcagaatcaagccataaagcagggcaaaagagacaacataacgccacggctttggaatatagaccgggcgcaggcgtgtccacagcagaactgccaccgccgtataggccagcgcgataagcacaattttcaggctgaaatactggcttaaatactcgctggcttcgttggtgttggtttcgaacatcacaaacagaacgctctgcgagaactcctgaccgtagatgacgtagtagcacagcgccgccagagaggccgcccatagcaccacgccgattactgcggcaataattttaatccgcttcggaaagaggaataccgggatcaaccacagcgaactgaataacagcgagtcgcgaatgccgttagtgccactataaccactgatgtaaataatggcctgtagcagagtagagaaaaaccaaaagtagagcagtgcccaacccagggctttccagctaaaaagaggtttagcctggacttctgtggaatgcatagtaagaacctgtcttgaaaaaatatcgccgaatgtaacgacaattccttaaggatatctgaaggtatattcagaatttgaataaaatgcagacagaaatatattgaaaacgagggggttagaacagaagtatttcagaaaaccctcgcgcaaaagcacgagggtttgcagaagaggaagattagccggtattacgcatacctgccgcaatcccggcaatagtgaccattaacgcttgttcgacgcgaggatccggttcctggccttctttttctgcctggcgggagcggtgcagcaactcggcctgcaatacgttcagcgggtcggtgtaaatattccgtagctgaatagactctgcaatccacggcagatcggccatcagatgggaatcgttggcaatcgccagcaccactttgatgtcttcttcttgcaggttgcgtaactctttacctaacggccacagtgctttgtctaccaggcgttggtcatagtattccgccagccacaggtctgctttggcgaagaccatctccagcatgccgagacgcgtcgagaagaatggccaatcgcggcacatagcctccagctcgctctgtttgccgtcttcgaccactttttgcagcgccgtacctgcacccagccaggcggggagcatcagacggttttgcgtccaggcgaagatccacggaatggcgcgtagtgactcgacgccgccggttgggcgacgtttcgccggacgtgaacccaacggcagtttgcccaattcttgttccggcgtagcggagcggaagtaaggcacaaaatctttgttttcacgtacgtagccacggtagagatcgcaggagatgactgacagttcatccataatgcgacgccagctctctttcggctcaggtggtggcagcaggttggcttccagaatcgccccggtgtacagcgacaggctgctgacggtgatttctggcagaccatatttaaagcggatcatctcgccctgttcagtcacgcgcaggccacctttcaggcttcctggcggttgtgacagcagcgccgcatgagcaggtgcgccgccgcgaccaatggaaccgccgcgaccgtggaacaacgtcagctcaatacccgctttttcgcaggttttgattaatgcatcctgtgcctgatattgcgcccaggaagctgccatcactcccgcatcttttgctgagtcggaatagccaatcatcaccatctgtttgccctgaatcaggccacgataccagtcaatattgagcagctgggtcatgacatcgttggcgttgttcagatcatcgagggtttcaaacagcggagcaaccggcatcgcaaacccgatacccgcttctttcagcagcaggtggacagccagtacgtcggacggcgttttcgccatcgagatcacgtaggcggcaatggagccttgcggtgcttcggcaatcacctggcaggtatcgagcacttcgcgcgtttcggcgcttggttgccagttgcgcggcagaagcggacgtttggagttcagttcgcggatcaggaacgcctgtttgtcggcctctgaccagctttcgtagtcgccgataccgaggtagcgggtcagctcgcccagcgcttcggtatgacgcgtgctctcctgacggatatcaatacggaccagcggtacgccgaaacatttcacgcggcgcagggtgtcgagcagatcgccgttggcgataatacccatgccacacgcctgaagtgactggtagcaagcgtagagcggttcccacagttcttcgttttgtgtcagcaggccttctggttttggcagttcttcgcctttcaggcgcgcttccagccatgcctgtgtcgccatcaggcgagaacgcaggtttttcatcagatagcgatacggttctgcggcaccttcttcgccaaccagcgccagcagttcaggggtcgcttcaaccatcgacagttcagaaaccagcacctgaatatctttcaggaacaaatcggtggctttccagcggctgagtagcaggacgtggcgggtgatatcggcagtgacgttcgggttgccgtcgcggtcgccgcccatccacgaagtaaaacggaccggaacaaattcgacgggcagtttgtagccgaggttctcttccagttgttcgttcagttcgcgcaggtaatttggtacgccttgccacaggctgttttccactacggcaaagccccatttggcttcatctaccgggcttggacgcagcttacggatttcatcggtatgccatgactgggcgatcaactggcgcaggcgacgcatcagctggttgtgttcgtagtcagcgatatctttgttatcgagctgttttaaacaggcgttcacttccaccattttgtggatcagtgtacgacgggtaatttcggttgggtgagccgtgaggaccagttccagcgacagcgattccactgcttttttgatggtgtcttcgctcagttccggctggtttttcagtttacgcagggtgcgggcgatcacttccgggttgctggcagcttcgcctttcggcgaaatgctgtggtattgctcggcggtgttggccaggttcaggaactgactaaacgcacgcgcaacgggcagcagctcgtcgttcgacaaattttgtaaggtggtgagcaactcctggcggttagcatcattgccagcgcgtgaagatttcgacaacttacggatagtttctacgcgttcaagaatgtgttctcccaacgcatccttgatggtttctcccagcactttgccgagcatactgacattactacgcaatgcggaatattgttcgttcatattaccccagacaccccatcttatcgtttgatagccctgtatccttcacgtcgcattggcgcgaatatgctcgggctttgcttttcgtcgtcttttataaagccacgtaaaagcggtgacgtcaaatgctgcgaaatcgcttcagcaaacgaataaatagcaggaatttacgccattaaattcacgacgctttaaataagcgtaacttatggaaatgttaaaaaatcgccatacataacaccaaaggtgtaggtcggataagatgcgcaagcatcgcatccgacattattgcggcacaggagtttggcaacggtgccggatgcggcgcgagcgccttatccggcctacgttttaatgccagcaaaaatggtgaattacctggataatcaactcacgggtgggtttaataaaccgcgtctccagatattcatcaggctgatgagcttgattgatggaacccggaccgagcaccagcgtagggcataacgtttgaataaacggcgcttcggtacagtaattcaccacttcggtttttgctccgagcaatttctcaaccacttcaaccagttgatgattcggtgggcattcatagccagggatcggcggatgcagctcgtcgaccgtcagacgacccggccagcgttcgctcaccggagccaatgcatcgttgagcaaaccattaagttcattgagtgtcatgccaggcagcggacgaatatccatatgcaactcacagcaagcgcaaatacggttagaagcgtcgccaccgtgaatatgcccgaggttgagcgtagggtatggcacggtaaacgcttcgtagtgataacgttctttcaggttatcgcgcaattgcaaaatatgcccgatggcgtcgtgcattagttcgatagcgttaactccgcgtgctggatcgctggagtgccccgactggccctgaatacggatggcgttagagatatgacctttatgtgcgcgtaccggttgtagtgacgtcggttcgccaatgatggcgcaatccgggcgcagggcggtagtttcggcaaaataacgcgctccggccatactggtttcttcatcagcagtcgccagaatgtagagcggttttttcagtttcgtgacgtcgacatcgcgtagcgcatcaaggataaacgcaaaaaagcctttcatgtcggcggtgcctaagccgtaaagcttgccgtcatgctccgtcagtgtaaacggatcgcgcgtccagcgaccgtcatcaaatggcaccgtatcggtatgccccgccagcaacaagccgccagccccctgtccgatacttgccagcatattgaatttgttgcgagttcctggaacaggctgcacttccacattgaagcccaaatctttaaaccagtccgccagcagagtgattaaatctgcattgctttgatcgagtgcctcttccgtggcgcttattgaaggtgtggcaatcagagcgcggtaaatctcgataaatggcggtaatttgtttttcattgttgacacacctctggtcatgatagtatcaatattcatgcagtatttatgaataaaaatacactaacgttgagcgtaataaaacccaccagccgtaaggtgaatgttttacgtttaacctggcaaccagacataagaaggtgaatagccccgatgttgaatacgctgattgtgggtgccagcggctacgctggcgcagagctagtgacctatgtaaatcgccatccgcatatgaacataaccgctttgactgtttcagcgcaaagcaatgatgcgggaaagttaatctccgatttgcatccgcagctaaaaggcatcgttgatctgccgttgcagccgatgtcggatatcagcgagtttagcccaggggtggacgtagtgtttctcgccaccgcccatgaagttagccacgatttagcgccgcagtttcttgaagcgggctgcgtggtgttcgacctttccggcgcgtttcgtgttaacgacgccaccttctatgaaaaatattacggctttacccatcaatacccggaactgttggaacaggcagcctacggtctggcggagtggtgcggtaataaattaaaagaagcgaatttgattgcggtgccgggctgttatccgacggcggcacagctggcgctgaaaccgttgattgatgccgatcttcttgacctcaatcagtggccggtgatcaacgccaccagcggcgtgagcggtgcagggcgtaaagcggccatttcaaacagcttttgtgaagttagcctgcaaccgtatggcgtctttactcatcgccatcaaccagagatcgccacacacctcggtgctgacgttatcttcaccccacatctgggcaatttcccgcgcggcattctcgaaaccattacctgccgcctgaaatcgggtgtgacccaggcgcaagtcgcgcaagtgttacagcaggcgtatgcccataaaccgctggtgcggctgtatgacaaaggcgttccggcgctgaaaaatgtcgttgggctgccattttgcgatatcgggtttgccgttcagggcgagcatttgattattgtggcgaccgaagacaacttactgaaaggcgcggcggcacaagcggtacagtgcgccaatattcgtttcggctatgcggaaacgcagtctcttatttaagggtgcaatgatgaatccattaattatcaaactgggcggcgtactgctggatagtgaagaggcgctggaacgtctgtttagcgcactggtgaattatcgtgagtcacatcagcgtccgctggtgattgtgcacggcggcggttgcgtggtggatgagctgatgaaagggctgaatctgccggtgaaaaagaaaaacggcctgcgggtgacgcctgctgatcagatagacattatcaccggagcactggcgggaacggcaaataaaaccctgttggcatgggcgaagaaacatcagattgcggccgtaggtttgtttctcggtgacggcgacagcgtcaaagtgacccagcttgatgaagagttaggtcatgttggactggcgcagccaggttcgcctaagcttatcaactccttgctggagaacggttatctgccggtggtcagctccattggcgtaacagacgaagggcaactgatgaacgtcaatgccgaccaggcggcaacggcgctggcggcaacgctgggcgcggatctgattttgctctccgacgtcagcggcattctcgacggcaaagggcaacgcattgccgaaatgaccgccgcgaaagcagaacaactgattgagcagggcattattactgacggcatgatagtgaaagtgaacgcggcgctggatgcggcccgcacgctgggccgtccggtagatatcgcctcctggcgtcatgcggagcagcttccggcactgtttaacggtatgccgatgggtacgcggattttagcttaagttttgttggccggaggcgcagctttccggcattgaatttcaaaataaggaaacagagttatggcactttggggcgggcgttttacccaggcagcagatcaacggttcaaacaattcaacgactcactgcgctttgattaccgtctggcggagcaggatattgttggctctgtggcctggtccaaagccctggtcacggtaggcgtgttaaccgcagaagagcaggcgcaactggaagaggcgctgaacgtgttgctggaagatgttcgcgccaggccacaacaaatccttgaaagcgacgccgaagatatccatagctgggtggaaggcaaactgatcgacaaagtgggccagttaggcaaaaagctgcataccgggcgtagccgtaatgatcaggtagcgactgacctgaaactgtggtgcaaagataccgttagcgagttactgacggctaaccggcagctgcaatcggcgctggtggaaaccgcacaaaacaatcaggacgcggtaatgccaggttacactcacctgcaacgcgcccagccggtgacgttcgcgcactggtgcctggcctatgttgagatgctggcgcgtgatgaaagccgtttgcaggatgcgcttaagcgtctggatgtcagcccgctaggctgtggcgcgctggcgggaacggcctatgaaatcgaccgtgaacagttagcaggctggctgggctttgcttcggcgacccgtaacagtctcgacagcgtttctgaccgtgaccatgtgttggaactgctttctgctgccgctatcggcatggtgcatctgtcgcgttttgctgaagatctgattttctttaacaccggcgaagcggggtttgtggagctttctgaccgcgtgacttccggttcatcattaatgccgcagaagaaaaacccggatgcgctggagctgattcgcggtaaatgcggtcgggtgcagggggcgttaaccggcatgatgatgacgctgaaaggtttgccgctggcttacaacaaagatatgcaggaagacaaagaaggtctgttcgacgcgctcgatacctggctggactgcctgcatatggcggcgctggtgctggacggcattcaggtgaaacgtccacgttgccaggaagcggctcagcagggttacgccaacgccaccgaactggcggattatctggtggcgaaaggcgtaccgttccgcgaggcgcaccatattgttggtgaagcggtggtggaagccattcgtcagggcaaaccgctggaagatctgccgctcagtgagttgcagaaattcagtcaggtgattgacgaagatgtctatccgattctgtcgctgcaatcgtgcctcgacaagcgtgcggcaaaaggcggcgtctcaccgcagcaggtggcgcaggcgattgcttttgcgcaggctcggttggggtaagaacatttatatgtacaaatttgagcctggcttatcgccgggcttttttatggcaaaaaaaagcggatcctggagatccgcaaaagttcacgttggctttagttattcgagttgagaaactctcgaaacgggcagtgacttcaagggttaaaagaggtgccgctccgtttctgtgagcaattatcagtcagaatgcttgatagggataatcgttcattgctattctacctatcgccatgaactatcgtggcgatggaggatggataatgaatattcgtgatcttgagtacctggtggcattggctgaacaccgccattttcggcgtgcggcagattcctgccacgttagccagccgacgcttagcgggcaaattcgtaagctggaagatgagttgggcgtgatgttgctggagcggaccagccgtaaagtgttgttcacccaggcgggaatgctgctggtggatcaggcgcgtaccgtgctgcgtgaggtgaaagtccttaaagagatggcaagccagcagggcgagacgatgtccggaccgctgcatattggtttgattcccacggttggaccgtacctgctaccgcatattatcccgatgctgcaccagacctttccaaagctggaaatgtatctgcatgaagcacagacccaccagttactggcgcaactggacagtggcaaactcgattgcgtgatcctcgcgctggtgaaagagagcgaagcattcattgaagtgccgttgtttgatgagccaatgttgctggctatctatgaagatcacccgtgggcgaaccgcgaatgcgtaccgatggccgatctggcaggggaaaaactgctgatgctggaagatggtcactgtttgcgcgatcaggcaatgggtttctgctttgaagccggggcggatgaagatacacacttccgcgcgaccagcctggagacactgcgtaacatggtggcggcaggtagcgggatcactttactgcctgcgctggctgtgccgccggagcgcaaacgcgatggggttgtttatttgccgtgtattaagccggaacctcgccgcacgattggcctggtttatcgtcctggctcaccgctgcgcagccgctatgagcagctggcagaggccatccgcgcaagaatggatggccatttcgataaagtgttaaaacaggcggtttaagccatttagcgcagctacccgataggcttccgccatcgtcgggtagttaaaggtggtgttgacgaagtactcaatagtgttgccgccacctttctgttccataatcgcctgaccgatatgaataatttcggcagcgcgctcgccaaagcagtgaatgcccagaatctcttttgtttcccgatggaacaaaattttcagcgtgcccacgttcatgccgacgatttgtgcacgtgccagatgtttgaactgggcgcggcccacttcatatggcactttcatcgcggtcagctgctgttcggttttgcccacagagctgatttccgggatggtgtaaatgccggtagggatatcttcaatcagatgtgcggtggcttcacctttcaccagcgcctgcgcggcaatgcgcccctggtcataggccgccgacgccaggctcggataaccaatcacgtcgcccaccgcgtaaacgtgcggctgtgcggtctgatacatgctgttgaccttcagctgtccgcgactgtcagtttccagcccaatgttctgtaacgccagcgaatcagtattaccggtgcgaccgttggcatagagcaggcagtcagctttcagttttttacccgacttcagatgcatgatcacaccgtcgtcacagccttcgatcttctcgtactcttcgttgtggcgaatcactacgccactgttccagaagtgataggagagagaatctgacatctcttgatcgagaaatgccagcagccgatcgcgggtgttgatcagatccacttttacatccataccgcggaagatcgacgcatattcacagccgatcactccagcaccatagataagtacatggcgcggttcgtggtgcatgctaagaattgagtcgctgtcgtaaatgcgtggatgggtgaaatcaacatctgttggatgatatggacgagagccgcaggcaataataaatttttcagcggttagtgtttcaacgctgccgtccgggcaatccagcgccaacgtatgctcgtcaacaaagcgagcgttcccctgcaatatttcacagtgattacgttcgtaaaatccctgacgcatgcgcgtttgttgattaatcacgttatcggcatggttaaggatatcggcaaaagaagagcggagcagtcgggaatggtcgctgtaaagtgggttttgattgaattctataatgcggctgacggcgtgacggagagctttcgacgggatggtgccccagtgggtgcaaccgccgccaacattttgataacgctcgataactgcgacgcgcgcaccttgcttaaccaggcccattgcagcgccttcgccgccggggccggaacctattactatggcatcgtaatcgtaggaatgtggcatggtagggcttacctgttcttatacataaaagcaacataatggtaacattttatcgcgggtaagccaattgatccccgtcatttatctggctatatcctgagcggcctttgctttgtctgtttcttacttttgccctgacgttttattggatttttatcgacgatactctccgtttaagcggcaggtttccgctgtacgtaaaagaaccggccaaagaattgcagtaaatatgttttattgcgttaccgttcattcacaatactggagcaatccagtatgttcattctctggtatagtgccagcagtacttttggcaaggattcagacatcgtgatgggcgtaagagcgcaacaaaaagaaaaaacccgccgttcgctggtggaagccgcatttagccaattaagtgctgaacgcagcttcgccagcctgagtttgcgtgaagtggcgcgtgaagcgggcattgctcccacctctttttatcggcatttccgcgacgtagacgaactgggtctgaccatggttgatgagagcggtttaatgctacgccaactcatgcgccaggcgcgtcagcgtatcgccaaaggcgggagtgtgatccgcacctcggtctccacatttatggagttcatcggtaataatcctaacgccttccggttattattgcgggaacgctccggcacctccgctgcgtttcgtgccgccgttgcgcgtgaaattcagcacttcattgcggaacttgcggactatctggaactcgaaaaccatatgccgcgtgcgtttactgaagcgcaagccgaagcaatggtgacaattgtcttcagtgcgggtgccgaggcgttggacatcggcgtcgaacaacgtcggcaattagaagagcgactggtactgcaactgcgaatgatttcgaaaggggcttattactggtatcgccgtgaacaagagaaaaccgcaattattccgggaaatgtgaaggacgagtaatgaaacaagcaaatcaagatagaggtacgctgctgctggcgttagttgctggcttatcgattaatggtactttcgcagcgctgtttagctccattgtgccattttctgtattcccgattatttccctggtgctgacggtttactgcctgcatcaacgttatcttaatcgcactatgccggtaggcttgccgggtctggcagctgcctgttttattctcggcgtactgctgtacagcacggtagttcgtgcggaatatccggatatcggctctaacttcttcccggcagtactctccgtcattatggtgttctggattggcgcgaagatgcgtaaccgtaagcaggaagttgctgagtaatcggaatcatgccggatgctggcgcatccggcatgggttttacttcgcggtcagtaatacgccgcactccatatggtgcgtgtaggggaactgatcaaacagagccagacgttcgaccttgtgcgtctggcttaatgtttccagattcttgcataacgtttccggattgcaggagatatacagaatacgtggatacgcctgcaccattttctcggtttcactgtccagaccgctgcgcggcgggtcgacaaaaatggtttcgcactgataactctttaagtcgatcccttgcaggcgattaaactcgcgtacaccattcatcgcctgagtaaattcttctgccgccatacgaataatttgtacgttatcaatatggttagctgcgatgttgtattgcgcagcagcaaccgacggcttagcgatttcggtggctaatacccgatcaaaattgcgcgccagtgctaatgaaaagttaccgttgccgcagtacagctccagtaaatcgccttttgagcctttggttacgtccagcgcccattccagcatctgaatattcatcgccgcgttcggctgggtaaaactgttttctacctgacggtagatcatctctttccctgcgaccggcagacgttcatcgatgtaatcctgatccagctcgattttggttttcgttgcccgaccaatcagatgcacattcagattctgcgcgcgcagtgcatcgcgcagggcttccgcttcctgacgccactcatcatccagctttttatggtacaacagggaaaccaccgcctgattactcagcgtggtgaggtaatcaatctggaacaacttgtggcgcagaacgggattattacgcacacccgcaatcatcgccgtcatcaactggttgatgagttcactggcagcggggaagctatccacgcggatgcggcttttggtttgttgatcgaaaatgatgtgatacaggtcatcgccatcgtgccagatgcggaactccgcacgcatccggtaatgactgaccggcgagcgaaacacttccggaaccaggtcagaaaacggtgccatcatactttgcaaacgtaccactttttcggctaactgcgcttcatactgttctgttggaaggtgttcgggggtcatgatgtatcctgaaaaattaaagtacgcggcgattgtagggattgctcatcagatgtccagatcttgatgaattcctatttgtgagctacgtctggacagtaacttgttacaacctgtagcatccacttgccggtcctgtgagttaatagggaatccagtgcgaatctggagctgacgcgcagcggtaaggaaaggtgcgatgattgcgttatgcggacactgccatccggtgggaagtcatcatctcttagtatcttagatacccctccaagcccgaagacctgccggccaacgtcgcatctggttctcatcatcgcgtaatattgatgaaacctgcggcatccttcttctattgtggatgctttacaatgattaaaaaagcttcgctgctgacggcgtgttctgtcacagccttttccgcttgggcacaggataccagcccggatactctcgtcgttactgctaaccgttttgaacagccgcgcagcactgtgcttgcaccaaccaccgttgtgacccgtcaggatatcgaccgctggcagtcgacctcggtcaatgatgtgctgcgccgtcttccgggcgtcgatatcacccaaaacggcggttcaggtcagctctcatctatttttattcgcggtacaaatgccagtcatgtgttggtgttaattgatggcgtacgcctgaatctggcgggggtgagtggttctgccgaccttagccagttccctattgcgcttgtccagcgtgttgaatatatccgtgggccgcgctccgctgtttatggttccgatgcaataggcggggtggtgaatatcatcacgacgcgcgatgaacccggaacggaaatttcagcagggtggggaagcaatagttatcagaactatgatgtctctacgcagcaacaactgggggataagacacgggtaacgctgttgggcgattatgcccatactcatggttatgatgttgttgcctatggtaataccggaacgcaagcgcagacagataacgatggttttttaagtaaaacgctttatggcgcgctggagcataactttactgatgcctggagcggctttgtgcgcggctatggctatgataaccgtaccaattatgacgcgtattattctcccggttcaccgttgctcgatacccgtaaactctatagccaaagttgggacgccgggctgcgctataacggcgaactgattaaatcacaactcattaccagctatagccatagcaaagattacaactacgatccccattttggtcgttatgattcgtcggcgacgctcgatgagatgaagcaatacaccgtccagtgggcaaacaatgtcatcgttggtcacggtagtattggtgcgggtgtcgactggcagaaacagactacgacgccgggtacaggttatgttgagaatggatatgatcaacgtaataccggcatctatctgaccgggctgcaacaagtcggcgattttacctttgaaggcgcagcacgcagtgacgataactcacagtttggtcgtcatggaacctggcaaaccagcgccggttgggaattcatcgaaggttatcgcttcattgcttcctacgggacatcttataaggcaccaaatctggggcaactgtatggcttctacggaaatccgaatctggacccggagaaaagcaaacagtgggaaggcgcgtttgaaggcttaaccgctggggtgaactggcgtatttccggatatcgtaacgatgtcagtgacttgatcgattatgatgatcacaccctgaaatattacaacgaagggaaagcgcggattaagggcgtcgaggcgaccgccaattttgataccggaccactgacgcatactgtgagttatgattatgtcgatgcgcgcaatgcgattaccgacacgccgttgttacgccgtgctaaacagcaggtgaaataccagctcgactggcagttgtatgacttcgactggggtattacttatcagtatttaggcactcgctatgataaggattactcatcttatccttatcaaaccgttaaaatgggcggtgtgagcttgtgggatcttgcggttgcgtatccggtcacctctcacctgacagttcgtggtaaaatagccaacctgttcgacaaagattatgagacagtctatggctaccaaactgcaggacgggaatacaccttgtctggcagctacaccttctgaaccacgtcccaccgtgctggtgtttgactccggcgtcggtgggttgtcggtctatgacgagatccggcatctcttaccggatctccattacatttatgctttcgataacgtcgcttttccgtatggcgaaaaaagcgaagagtttattgttgagcgagtggtggcaattgtcaccgcagtgcaagaacgttatccccttgcgctggctgtggtcgcttgcaacaccgccagtaccgtttcacttcctgcattacgcgaaaagttcgacttcccggttgttggtgtcgtgccggcgattaaacctgctgcacgtctgacggcaaatggcattgtcggattactggcaacccgcggaactgttaaacgttcttatactcatgagctgatcgcgcgtttcgctaatgaatgccagatagaaatgctgggctcggcagagatggttgagttggctgaagcgaagctgcatggcgaagatgtttctctggatgcactaaaacgtatcctacgcccgtggttaagaatgaaagagccgccagataccgttgtattgggttgcacccatttccctctactacaagaagaactcttacaggtgctgccagagggaacccggctggtggattctggcgcagcgattgctcgcagaacggcctggctgttagaacatgaagctccggatgcaaaatctgccgatgcgaatattgccttttgtatggcaatgacgccagaagctgaacaattattgcccgttttacagcgttacggcttcgaaacgctcgaaaaactggcagttttaggctgatttggttgaatgttgcgcggtcagaaaattattttaaatttcctcttgtcaggccggaataactccctataatgcgccaccactgacacggaacaacggcaaacacgccgccgggtcagcggggttctcctgagaattccgacagagaaagcaaaaataaatgcttgactctgtagcgggaaagcgtattatgcacaccccgcgccgctgagaaaaagcaaagcggcactgctctttaacaatttatcagacaatctgtgtgggcactcgaagatacggattcttaacgtcgcaagacgaaaaatgaataccaagtctcaagagtgaacacgtaattcattacgaagtttaattctttgagcatcaaacttttaaattgaagagtttgatcatggctcagattgaacgctggcggcaggcctaacacatgcaagtcgaacggtaacagaaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagcttgttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggcttcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgttctttgaagtgctcacacagattgtctgatagaaagtgaaaagcaaggcgtcttgcgaagcagactgatacgtccccttcgtctagaggcccaggacaccgccctttcacggcggtaacaggggttcgaatcccctaggggacgccacttgctggtttgtgagtgaaagtcacctgccttaatatctcaaaactcatcttcgggtgatgtttgagatatttgctctttaaaaatctggatcaagctgaaaattgaaacactgaacaacgagagttgttcgtgagtctctcaaattttcgcaacacgatgatgaatcgaaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggagcagcccagagcctgaatcagtgtgtgtgttagtggaagcgtctggaaaggcgcgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaattcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagcctgcgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaactaaggctgagacgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagtccctcgcggatggagctgaaatcagtcgaagataccagctggctgcaactgtttattaaaaacacagcactgtgcaaacacgaaagtggacgtatacggtgtgacgcctgcccggtgccggaaggttaattgatggggtcagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggcttggaagtgtggacgccagtctgcatggagccgaccttgaaataccaccctttaatgtttgatgttctaacgttgacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaagctgttttggcggattgagagaagattttcagcctgatacagattaaatcagaacgcagaagcggtctgataaaacagaatttgcctggcggccttagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggaaggtggcgggcaggacgcccgccataaactgccaggcatcaaattaagcagaaggccatcctgacggatggcctttttgcgtttctacaaactcttcctgtcgtcatatctacaagccatccccccacagatacggtaaactagcctcgtttttgcatcaggaaagcagctatgaaccactccttaaaaccctggaacacatttggcattgatcataatgctcagcacattgtatgtgccgaagacgaacaacaattactcaatgcctggcagtatgcaaccgcagaaggacaacccgttcttattctgggtgaaggaagtaatgtactttttctggaagactatcgcggcacggtgatcatcaaccggatcaaaggtatcgaaattcatgatgaacctgatgcgtggtatttacatgtaggagccggagaaaactggcatcgcctggtaaaatacactttgcaggaaggtatgcctggtctggaaaatctggcattaattcctggttgtgtcggctcatcacctatccagaatattggtgcttatggcgtagaattacagcgagtttgcgcttatgttgattgtgttgaactggcgacaggcaagcaagtgcgcttaactgccaaagagtgccgttttggctatcgcgacagtatttttaaacatgaataccaggatcgcttcgccattgtagccgtaggtctgcgtctgccaaaagagtggcaacctgtactaacgtatggtgacttaactcgtctggatcctacaacagtaacgccacagcaagtatttaatgcggtgtgtcatatgcgcaccaccaaactccctgatccaaaagtgaatggcaatgccggtagtttcttcaaaaaccctgttgtatctgccgaaacggctaaagcattactggcgcaatttccaacagcaccaaattacccccaggcgggtggttcagtaaaactggcagcaggttggcttattgatcagtgccagctaaaagggatgcaaatgggtggggctgcggtgcaccgtcaacaggcgttagttctcattaatgaagacaatgcaaaaagcgaagatgtggtgcaactggcacaccatgtaagacaaaaagtgggtgaaaaatttaatgtctggcttgagcctgaagtccgctttattggtgcatcaggtgaagtgagcgcagtggagacaatttcatgaaggataacaccgtgccactgaaattgattgccctgttagcgaacggtgaatttcactctggcgagcagttgggtgaaacgctgggaatgagccgggcggctattaataaacacattcagacactgcgtgactggggcgttgatgtctttaccgttccgggtaaaggatacagcctgcctgagcccatccagttacttaatgctgaacagatattgggtcagctggatggcggtagtgtagccgtgctgccagttattgactccacgaatcagtaccttcttgatcgtatcggagagcttaaatcgggcgatgcctgtgttgcagaataccagcaggctggccgtggtcgccgggggcggaaatggttttcgccttttggcgcaaacttatatttgtcgatgttctggcgtctggaacaaggcccggcggcggcgattggtttaagtctggttatcggtatcgtgatggcggaagtattacgcaagctgggagcagataaagttcgtgtcaaatggcctaatgacctctatctgcaggatcgcaagctggcaggcattcttgtggagctgactggcaaaactggcgatgcggcgcaaatagtcattggagccgggatcaacatggcaatgcgccgtgttgaagagagtgtcgttaatcaggggtggatcacgctgcaggaagcggggatcaatctcgatcgtaatacgttggcggccatgctaatacgtgaattacgtgctgcgttggaactcttcgaacaagaaggattggcaccttatctgtcgcgctgggaaaagctggataattttattaatcgcccagtgaaacttatcattggtgataaagaaatatttggcatttcacgcggaatagacaaacagggggctttattacttgagcaggatggaataataaaaccctggatgggcggtgaaatatccctgcgtagtgcagaaaaataagaaaggggagtattcgctcccctgcaaattatttgcgtagtctgacctcttctaccgcatgatttgcacttttcgtcaggattaaactggcgcgctcacgagtaggtagaatattttgctttaagttcagccagttgatctctttccacaatgtcatggcagtcttaatcgcttcttctttagttaatttcgcgtagttatgaaaataggaatccgggtcggtaaaagccccttcgcggaatttcagaaaacggttgatataccatgtctgaagtaagtcttccggtgcatcaacatatatcgaaaaatcgacaaaatcagaaacaaatacatgatgtggatcgtgtggataatccatcccgctctgtaagacatttaacccttcaagaattaaaatatcaggctgaacaaccgttttatctccatccgggatcacatcataaataagatgtgagtaaacaggtgctgtaacgtttggcacgccggatttgagatcggaaacaaacttcaccaggcgatgcatatcatacgattccgggaagcctttcttcttcatcagaccacgttctttcagaacctgattagggtgaaggaagccatctgtagtgatcagttcaacacgacgatgttccggccaacggcttaatagcgcctgcaatacacgggcggttgtacttttccccaccgcgacactgccagcaatactgataatgtaaggaatgcgttgcccgttggtaccaagaaactgttccagaactgcctgacggcgcagattcgagcttatatagaagttcagcaaacgtgacaaaggtaaatagatctcggcaacttcttctaacgagagatcttcattaatacctttgagacgggcgatctcatcttccgataacgtcataggtacggaatcacgcagagctgcccactggttgcggtcaaactgtaggtaaggcgtcattaacgtttgctcttttatactcataagcatgtttctggcggtcatagctctatcggcaaagcgatatttgccatggcgcgtcacagttctgttgaatgggttaatgggcaggagggtaacaccagatggggaggaataataagaaaaaatctctgccaggaagctatcgttgaaaagcaatgtgacagatattccatctgataaaaagaattatggtttagcaggagcgcattgttgagcacaatgatgttgaaaaagtgtgctaatctgccctccgttcggctgtttcttcatcgtgtcgcataaaatgtgaccaataaaacaaattatgcaattttttagttgcatgaactcgcatgtctccatagaatgcgcgctacttgatgccgacttagctcagtaggtagagcaactgacttgtaatcagtaggtcaccagttcgattccggtagtcggcaccatcaagtccggtggggttcccgagcggccaaagggagcagactgtaaatctgccgtcacagacttcgaaggttcgaatccttcccccaccaccaatttcggccacgcgatggcgtagcccgagacgataagttcgcttaccggctcgaataaagagagcttctctcgatattcagtgcagaatgaaaatcaggtagccgagttccaggatgcgggcatcgtataatggctattacctcagccttccaagctgatgatgcgggttcgattcccgctgcccgctccaagatgtgctgatatagctcagttggtagagcgcacccttggtaagggtgaggtcggcagttcgaatctgcctatcagcaccacttcttttctcctccctgttttttccttctgtttattgcattcaacaagtcgggcatgttgcctggttgatgtggtgatatcaccgatttatccgtgtcttagagggacaatcgatgtctaaagaaaagtttgaacgtacaaaaccgcacgttaacgtcggtactatcggccacgttgaccatggtaaaacaacgctgaccgctgcaatcactaccgtactggctaaaacctacggcggtgctgctcgcgcattcgaccagatcgataacgcgccggaagaaaaagctcgtggtatcaccatcaacacttctcacgttgaatacgacaccccgacccgtcactacgcacacgtagactgcccggggcacgccgactatgttaaaaacatgatcaccggtgctgctcagatggacggcgcgatcctggtagttgctgcgactgacggcccgatgccgcagactcgtgagcacatcctgctgggtcgtcaggtaggcgttccgtacatcatcgtgttcctgaacaaatgcgacatggttgatgacgaagagctgctggaactggttgaaatggaagttcgtgaacttctgtctcagtacgacttcccgggcgacgacactccgatcgttcgtggttctgctctgaaagcgctggaaggcgacgcagagtgggaagcgaaaatcctggaactggctggcttcctggattcttacattccggaaccagagcgtgcgattgacaagccgttcctgctgccgatcgaagacgtattctccatctccggtcgtggtaccgttgttaccggtcgtgtagaacgcggtatcatcaaagttggtgaagaagttgaaatcgttggtatcaaagagactcagaagtctacctgtactggcgttgaaatgttccgcaaactgctggacgaaggccgtgctggtgagaacgtaggtgttctgctgcgtggtatcaaacgtgaagaaatcgaacgtggtcaggtactggctaagccgggcaccatcaagccgcacaccaagttcgaatctgaagtgtacattctgtccaaagatgaaggcggtcgtcatactccgttcttcaaaggctaccgtccgcagttctacttccgtactactgacgtgactggtaccatcgaactgccggaaggcgtagagatggtaatgccgggcgacaacatcaaaatggttgttaccctgatccacccgatcgcgatggacgacggtctgcgtttcgcaatccgtgaaggcggccgtaccgttggcgcgggcgttgtagcaaaagttctgagctaattgccgataacatttgacgcaatgcgcactaaaagggcatcatttgatgccctttttgcacgctttcgtaccagaacctggctcatcagtgattttctttgtcataatcattgctgagacaggctctgttgagggcgtataatccgaaaagctaatacgcgtttcgatttggtttgcctcgcgatcgcggggtgaaaatgtttgtagaaaacttctgacaggttggtttatgagtgcgaataccgaagctcaaggaagcgggcgcggcctggaagcgatgaagtgggtcgttgtggtggcattgctcctggtggcgattgtcggcaactacctttatcgcgacattatgctgccgctgcgtgcgctggccgtagtaattctgattgctgcagcgggtggtgtcgcgctgttaacgacaaaaggtaaagctaccgttgcttttgcccgtgaagcgcgtaccgaagtccgtaaggtcatttggccgactcgccaggaaacattgcacaccacgctgattgtggctgcggttaccgcagtaatgtcactgatcctgtggggactggatggtattctggttcgcctggtatcctttatcactggcctgaggttctgagatgtctgaagctcctaaaaagcgctggtacgtcgttcaggcgttttccggttttgaaggccgcgtagcaacgtcgctgcgtgagcatatcaaattacacaacatggaagatttgtttggtgaagtcatggtaccaaccgaagaagtggttgaaatccgtggcggtcagcgtcgcaaaagcgaacgtaaattcttccctggctacgtcctcgttcagatggtgatgaacgacgcgagctggcacctggtgcgcagcgtaccgcgtgtgatgggcttcatcggcggtacttccgatcgtcctgcgccaatcagcgataaagaagtcgatgcgattatgaaccgcctgcagcaggttggtgataagccgcgtccgaaaacgctgtttgaaccgggtgaaatggtccgtgttaatgatggtccgttcgctgacttcaacggtgttgttgaagaagtggattacgagaaatctcgtctgaaagtgtctgtttctatcttcggtcgtgcgaccccggtagagctggacttcagccaggttgaaaaagcctaacccagcgatcaaaaaagcggcgatttaatcgttgcacaaggcgtgagattggaatacaatttcgcgccttttgtttttatgggccttgcccgtaaaacgattttttatatcacggggagcctctcagaggcgttattacccaacttgaggaatttataatggctaagaaagtacaagcctatgtcaagctgcaggttgcagctggtatggctaacccgagtccgccagtaggtccggctctgggtcagcagggcgtaaacatcatggaattctgcaaagcgttcaacgcaaaaactgattccatcgaaaaaggtctgccgattccggtagtaatcaccgtttacgctgaccgttctttcactttcgttaccaagactccgccggcagcagttctgctgaaaaaagcggctggtatcaagtctggttccggtaagccgaacaaagacaaagtgggtaaaatttcccgcgctcagctgcaggaaatcgcgcagaccaaagctgccgacatgactggtgccgacattgaagcgatgactcgctccatcgaaggtactgcacgttccatgggcctggtagtggaggactaagaaatggctaaactgaccaagcgcatgcgtgttatccgcgagaaagttgatgcaaccaaacagtacgacatcaacgaagctatcgcactgctgaaagagctggcgactgctaaattcgtagaaagcgtggacgtagctgttaacctcggcatcgacgctcgtaaatctgaccagaacgtacgtggtgcaactgtactgccgcacggtactggccgttccgttcgcgtagccgtatttacccaaggtgcaaacgctgaagctgctaaagctgcaggcgcagaactggtaggtatggaagatctggctgaccagatcaagaaaggcgaaatgaactttgacgttgttattgcttctccggatgcaatgcgcgttgttggccagctgggccaggttctgggtccgcgcggcctgatgccaaacccgaaagtgggtactgtaacaccgaacgttgctgaagcggttaaaaacgctaaagctggccaggttcgttaccgtaacgacaaaaacggcatcatccacaccaccatcggtaaagtggactttgacgctgacaaactgaaagaaaacctggaagctctgctggttgcgctgaaaaaagcaaaaccgactcaggcgaaaggcgtgtacatcaagaaagttagcatctccaccaccatgggtgcaggtgttgcagttgaccaggctggcctgagcgcttctgtaaactaatgcctttacgtgggcggtgattttgtctacaatcttacccccacgtataatgcttaatgcagacgtatatccgagatattcgggttgtggcaaggcggcaactgagtgagtcgccaggagcatagctaactatgtgactggtgcgaatgaaggaagccaacgccgccacaagttgaatagcgacggatagaaaagatttgttcgttggagcctggcctatccaggcctccgtcgaagaccgcaggagtttcgcaagaaacttaatcccctgcgtagacggtgacagaacgctaagattattcttttatattctggcttgtttctgctcaccgtaattaagacgctctctccgtttggaggagtgaagtgagttccagagattttctctggcaaacatccaggagcaaagctaatggctttaaatcttcaagacaaacaagcgattgttgctgaagtcagcgaagtagccaaaggcgcgctgtctgcagtagttgcggattcccgtggcgtaactgtagataaaatgactgaactgcgtaaagcaggtcgcgaagctggcgtatacatgcgtgttgttcgtaacaccctgctgcgccgtgctgttgaaggtactccgttcgagtgcctgaaagacgcgtttgttggtccgaccctgattgcatactctatggaacacccgggcgctgctgctcgtctgttcaaagagttcgcgaaagcgaatgcaaaatttgaggtcaaagccgctgcctttgaaggtgagctgatcccggcgtctcagatcgaccgcctggcaactctgccgacctacgaagaagcaattgcacgcctgatggcaaccatgaaagaagcttcggctggcaaactggttcgtactctggctgctgtacgcgatgcgaaagaagctgcttaatcgcagttatctttttaacgcattcgcttacgtataaacttattctgatattcaggaacaatttaaatgtctatcactaaagatcaaatcattgaagcagttgcagctatgtctgtaatggacgttgtagaactgatctctgcaatggaagaaaaattcggtgtttccgctgctgctgctgtagctgtagctgctggcccggttgaagctgctgaagaaaaaactgaattcgacgtaattctgaaagctgctggcgctaacaaagttgctgttatcaaagcagtacgtggcgcaactggcctgggtctgaaagaagctaaagacctggtagaatctgcaccggctgctctgaaagaaggcgtgagcaaagacgacgcagaagcactgaaaaaagctctggaagaagctggcgctgaagttgaagttaaataagccaacccttccggttgcagcctgagaaatcaggctgatggctggtgactttttagtcaccagcctttttgcgctgtaaggcgccagtagcgtttcacactgtttgactactgctgtgcctttcaatgcttgtttctatcgacgacttaatatactgcgacaggacgtccgttctgtgtaaatcgcaatgaaatggtttaagcgtgatagcaacaggcattgcggaaagtgttccattttccggtcaacaaaatagtgttgcacaaactgtccgctcaatggacagatgggtcgacttgtcagcgagctgaggaaccctatggtttactcctataccgagaaaaaacgtattcgtaaggattttggtaaacgtccacaagttctggatgtaccttatctcctttctatccagcttgactcgtttcagaaatttatcgagcaagatcctgaagggcagtatggtctggaagctgctttccgttccgtattcccgattcagagctacagcggtaattccgagctgcaatacgtcagctaccgccttggcgaaccggtgtttgacgtccaggaatgtcaaatccgtggcgtgacctattccgcaccgctgcgcgttaaactgcgtctggtgatctatgagcgcgaagcgccggaaggcaccgtaaaagacattaaagaacaagaagtctacatgggcgaaattccgctcatgacagacaacggtacctttgttatcaacggtactgagcgtgttatcgtttcccagctgcaccgtagtccgggcgtcttctttgactccgacaaaggtaaaacccactcttcgggtaaagtgctgtataacgcgcgtatcatcccttaccgtggttcctggctggacttcgaattcgatccgaaggacaacctgttcgtacgtatcgaccgtcgccgtaaactgcctgcgaccatcattctgcgcgccctgaactacaccacagagcagatcctcgacctgttctttgaaaaagttatctttgaaatccgtgataacaagctgcagatggaactggtgccggaacgcctgcgtggtgaaaccgcatcttttgacatcgaagctaacggtaaagtgtacgtagaaaaaggccgccgtatcactgcgcgccacattcgccagctggaaaaagacgacgtcaaactgatcgaagtcccggttgagtacatcgcaggtaaagtggttgctaaagactatattgatgagtctaccggcgagctgatctgcgcagcgaacatggagctgagcctggatctgctggctaagctgagccagtctggtcacaagcgtatcgaaacgctgttcaccaacgatctggatcacggcccatatatctctgaaaccttacgtgtcgacccaactaacgaccgtctgagcgcactggtagaaatctaccgcatgatgcgccctggcgagccgccgactcgtgaagcagctgaaagcctgttcgagaacctgttcttctccgaagaccgttatgacttgtctgcggttggtcgtatgaagttcaaccgttctctgctgcgcgaagaaatcgaaggttccggtatcctgagcaaagacgacatcattgatgttatgaaaaagctcatcgatatccgtaacggtaaaggcgaagtcgatgatatcgaccacctcggcaaccgtcgtatccgttccgttggcgaaatggcggaaaaccagttccgcgttggcctggtacgtgtagagcgtgcggtgaaagagcgtctgtctctgggcgatctggataccctgatgcctcaggatatgatcaacgccaagccgatttccgcagcagtgaaagagttcttcggttccagccagctgtctcagtttatggaccagaacaacccgctgtctgagattacgcacaaacgtcgtatctccgcactcggcccaggcggtctgacccgtgaacgtgcaggcttcgaagttcgagacgtacacccgactcactacggtcgcgtatgtccaatcgaaacccctgaaggtccgaacatcggtctgatcaactctctgtccgtgtacgcacagactaacgaatacggcttccttgagactccgtatcgtaaagtgaccgacggtgttgtaactgacgaaattcactacctgtctgctatcgaagaaggcaactacgttatcgcccaggcgaactccaacctggatgaagaaggccacttcgtagaagacctggtaacttgccgtagcaaaggcgaatccagcttgttcagccgcgaccaggttgactacatggacgtatccacccagcaggtggtatccgtcggtgcgtccctgatcccgttcctggaacacgatgacgccaaccgtgcattgatgggtgcgaacatgcaacgtcaggccgttccgactctgcgcgctgataagccgctggttggtactggtatggaacgtgctgttgccgttgactccggtgtaactgcggtagctaaacgtggtggtgtcgttcagtacgtggatgcttcccgtatcgttatcaaagttaacgaagacgagatgtatccgggtgaagcaggtatcgacatctacaacctgaccaaatacacccgttctaaccagaacacctgtatcaaccagatgccgtgtgtgtctctgggtgaaccggttgaacgtggcgacgtgctggcagacggtccgtccaccgacctcggtgaactggcgcttggtcagaacatgcgcgtagcgttcatgccgtggaatggttacaacttcgaagactccatcctcgtatccgagcgtgttgttcaggaagaccgtttcaccaccatccacattcaggaactggcgtgtgtgtcccgtgacaccaagctggggccggaagagatcaccgctgacatcccgaacgtgggtgaagctgcgctctccaaactggatgaatccggtatcgtttacattggtgcggaagtgaccggtggcgacattctggttggtaaggtaacgccgaaaggtgaaactcagctgaccccagaagaaaaactgctgcgtgcgatcttcggtgagaaagcctctgacgttaaagactcttctctgcgcgtaccaaacggtgtatccggtacggttatcgacgttcaggtctttactcgcgatggcgtagaaaaagacaaacgtgcgctggaaatcgaagaaatgcagctcaaacaggcgaagaaagacctgtctgaagaactgcagatcctcgaagcgggtctgttcagccgtatccgtgctgtgctggtagccggtggcgttgaagctgagaagctcgacaaactgccgcgcgatcgctggctggagctgggcctgacagacgaagagaaacaaaatcagctggaacagctggctgagcagtatgacgaactgaaacacgagttcgagaagaaactcgaagcgaaacgccgcaaaatcacccagggcgacgatctggcaccgggcgtgctgaagattgttaaggtatatctggcggttaaacgccgtatccagcctggtgacaagatggcaggtcgtcacggtaacaagggtgtaatttctaagatcaacccgatcgaagatatgccttacgatgaaaacggtacgccggtagacatcgtactgaacccgctgggcgtaccgtctcgtatgaacatcggtcagatcctcgaaacccacctgggtatggctgcgaaaggtatcggcgacaagatcaacgccatgctgaaacagcagcaagaagtcgcgaaactgcgcgaattcatccagcgtgcgtacgatctgggcgctgacgttcgtcagaaagttgacctgagtaccttcagcgatgaagaagttatgcgtctggctgaaaacctgcgcaaaggtatgccaatcgcaacgccggtgttcgacggtgcgaaagaagcagaaattaaagagctgctgaaacttggcgacctgccgacttccggtcagatccgcctgtacgatggtcgcactggtgaacagttcgagcgtccggtaaccgttggttacatgtacatgctgaaactgaaccacctggtcgacgacaagatgcacgcgcgttccaccggttcttacagcctggttactcagcagccgctgggtggtaaggcacagttcggtggtcagcgtttcggggagatggaagtgtgggcgctggaagcatacggcgcagcatacaccctgcaggaaatgctcaccgttaagtctgatgacgtgaacggtcgtaccaagatgtataaaaacatcgtggacggcaaccatcagatggagccgggcatgccagaatccttcaacgtattgttgaaagagattcgttcgctgggtatcaacatcgaactggaagacgagtaattctcgctcaaacaggtcactgctgtcggggtaaaacccggcagcggattgtgctaactccgacgggagcaaatccgtgaaagatttattaaagtttctgaaagcgcagactaaaaccgaagagtttgatgcgatcaaaattgctctggcttcgccagacatgatccgttcatggtctttcggtgaagttaaaaagccggaaaccatcaactaccgtacgttcaaaccagaacgtgacggccttttctgcgcccgtatctttgggccggtaaaagattacgagtgcctgtgcggtaagtacaagcgcctgaaacaccgtggcgtcatctgtgagaagtgcggcgttgaagtgacccagactaaagtacgccgtgagcgtatgggccacatcgaactggcttccccgactgcgcacatctggttcctgaaatcgctgccgtcccgtatcggtctgctgctcgatatgccgctgcgcgatatcgaacgcgtactgtactttgaatcctatgtggttatcgaaggcggtatgaccaacctggaacgtcagcagatcctgactgaagagcagtatctggacgcgctggaagagttcggtgacgaattcgacgcgaagatgggtgcggaagcaatccaggctctgctgaagagcatggatctggagcaagagtgcgaacagctgcgtgaagagctgaacgaaaccaactccgaaaccaagcgtaaaaagctgaccaagcgtatcaaactgctggaagcgttcgttcagtctggtaacaaaccagagtggatgatcctgaccgttctgccggtactgccgccagatctgcgtccgctggttccgctggatggtggtcgtttcgcgacttctgacctgaacgatctgtatcgtcgcgtcattaaccgtaacaaccgtctgaaacgtctgctggatctggctgcgccggacatcatcgtacgtaacgaaaaacgtatgctgcaggaagcggtagacgccctgctggataacggtcgtcgcggtcgtgcgatcaccggttctaacaagcgtcctctgaaatctttggccgacatgatcaaaggtaaacagggtcgtttccgtcagaacctgctcggtaagcgtgttgactactccggtcgttctgtaatcaccgtaggtccatacctgcgtctgcatcagtgcggtctgccgaagaaaatggcgctggagctgttcaaaccgttcatctacggcaagctggaactgcgtggtcttgctaccaccattaaagctgcgaagaaaatggttgagcgcgaagaagctgtcgtttgggatatcctggacgaagttatccgcgaacacccggtactgctgaaccgtgcaccgactctgcaccgtctgggtatccaggcatttgaaccggtactgatcgaaggtaaagctatccagctgcacccgctggtttgtgcggcatataacgccgacttcgatggtgaccagatggctgttcacgtaccgctgacgctggaagcccagctggaagcgcgtgcgctgatgatgtctaccaacaacatcctgtccccggcgaacggcgaaccaatcatcgttccgtctcaggacgttgttctgggtctgtactatatgacccgtgactgtgttaacgccaaaggcgaaggcatggtgctgactggcccgaaagaagcagaacgtctgtatcgctctggtctggcttctctgcatgcgcgcgttaaagtgcgtatcaccgagtatgaaaaagatgcaaacggtgaattagtagcgaaaaccagcctgaaagacacgactgttggccgtgccattctgtggatgattgtaccgaaaggtctgccttactccatcgtcaaccaggcgctgggtaaaaaagcaatctccaaaatgctgaacacctgctaccgcattctcggtctgaaaccgaccgttatttttgcggaccagatcatgtacaccggcttcgcctatgcagcgcgttctggtgcatctgttggtatcgatgacatggtcatcccggagaagaaacacgaaatcatctccgaggcagaagcagaagttgctgaaattcaggagcagttccagtctggtctggtaactgcgggcgaacgctacaacaaagttatcgatatctgggctgcggcgaacgatcgtgtatccaaagcgatgatggataacctgcaaactgaaaccgtgattaaccgtgacggtcaggaagagaagcaggtttccttcaacagcatctacatgatggccgactccggtgcgcgtggttctgcggcacagattcgtcagcttgctggtatgcgtggtctgatggcgaagccggatggctccatcatcgaaacgccaatcaccgcgaacttccgtgaaggtctgaacgtactccagtacttcatctccacccacggtgctcgtaaaggtctggcggataccgcactgaaaactgcgaactccggttacctgactcgtcgtctggttgacgtggcgcaggacctggtggttaccgaagacgattgtggtacccatgaaggtatcatgatgactccggttatcgagggtggtgacgttaaagagccgctgcgcgatcgcgtactgggtcgtgtaactgctgaagacgttctgaagccgggtactgctgatatcctcgttccgcgcaacacgctgctgcacgaacagtggtgtgacctgctggaagagaactctgtcgacgcggtaaaagtacgttctgttgtatcttgtgacaccgactttggtgtatgtgcgcactgctacggtcgtgacctggcgcgtggccacatcatcaacaaaggtgaagcaatcggtgttatcgcggcacagtccatcggtgaaccgggtacacagctgaccatgcgtacgttccacatcggtggtgcggcatctcgtgcggctgctgaatccagcatccaggtgaaaaacaaaggtagcatcaagctcagcaacgtgaagtcggttgtgaactccagcggtaaactggttatcacttcccgtaatactgaactgaaactgatcgacgaattcggtcgtaccaaagaaagctacaaagtaccttacggtgcggtactggcgaaaggcgatggcgaacaggttgctggcggcgaaaccgttgcaaactgggacccgcacaccatgccggttatcaccgaagtaagcggttttgtacgctttactgacatgatcgacggtcagaccattactcgtcagacagacgaattgaccggtctgtcttcgctggtggttctggattccgcagaacgtacagcaggtggtaaagatctgcgtccggcactgaaaatcgttgatgctcagggtaacgacgttctgatcccaggtaccgatatgcctgcgcagtacttcctgccgggtaaagcgattgttcagctggaagatggcgtacagatcagctctggtgacaccctggcgcgtattccgcaggaatccggcggtaccaaggacatcaccggtggtctgccgcgcgttgcggacctgttcgaagcacgtcgtccgaaagagccggcaatcctggctgaaatcagcggtatcgtttccttcggtaaagaaaccaaaggtaaacgtcgtctggttatcaccccggtagacggtagcgatccgtacgaagagatgattccgaaatggcgtcagctcaacgtgttcgaaggtgaacgtgtagaacgtggtgacgtaatttccgacggtccggaagcgccgcacgacattctgcgtctgcgtggtgttcatgctgtgactcgttacatcgttaacgaagtacaggacgtataccgtctgcagggcgttaagattaacgataaacacatcgaagttatcgttcgtcagatgctgcgtaaagctaccatcgttaacgcgggcagctccgacttcctggaaggcgaacaggttgaatactctcgcgtcaagatcgcaaaccgcgaactggaagcgaacggcaaagtgggtgcaacttactcccgcgatctgctgggtatcaccaaagcgtctctggcaaccgagtccttcatctccgcggcatcgttccaggagaccactcgcgtgctgaccgaagcagccgttgcgggcaaacgcgacgaactgcgcggcctgaaagagaacgttatcgtgggtcgtctgatcccggcaggtaccggttacgcgtaccaccaggatcgtatgcgtcgccgtgctgcgggtgaagctccggctgcaccgcaggtgactgcagaagacgcatctgccagcctggcagaactgctgaacgcaggtctgggcggttctgataacgagtaatcgttaatccgcaaataacgtaaaaacccgcttcggcgggtttttttatggggggagtttagggaaagagcatttgtcagaatatttaaggaatttctgaatactcataatcaatgtagagatgactaatatcctgaaactgactgaactaattgagtcaaactcggcaaggattcgatactattcctgtgtaactttcttaaggaacgagaatgaaacaggaagtggaaaagtggcgaccttttggacatccggatggtgatattcgtgatttatcatttcttgatgctcatcaggctgtctacgttcagcatcatgagggcaaagagcctttagagtatcgcttttgggttacctactctcttcactgcttcacaaaagattatgaacatcagacgaacgaagaaaaacaatcgttaatgtaccacgcgcctaaagaatctcgtcccttctgccagcaccgttataacttagcgcgcacacacttaaaaagaactattttggcgctgccagaaagcaacgttattcatgccgggtatggtagctatgccgtgattgaggtggacttagacggaggagataaggcattttactttgttgcgttcagggctttcagggaaaagaaaaaactccgtttgcatgtaactagcgcttatcccatttctgaaaaacagaaaggtaaatcagtgaaatttttcaccattgcctacaacttattgagaaataagcagcttcctcagccctcaaaataacaaaacccaccttaaggtgggtttcgccagagaattatctctggtattcagaacgccattaccggactttgccttgaccttgcgataatcgcaggttgcgggatgtctgaatttcttcagtctgctgcatcctggaagatgagaacatgtgttcttattttcgtctctatcatagttgagtatttactctcttacaatcagatctctttcattgctcaacaggcgatggcttcagactttgcattacggaatttttaagaaaggcagggcgaaacgaggaagaagcttttcgccctggacaacattcctgctgacggcactaccataaaaaaacacaacgctttcaacaaccttgcgtttttcatcttccgtagcggctcggaataaatttacgttcttacattccgtctcatagtctttgcgaggcccgtcccagatagctgtcccagtctttccataccggctgcaaaccctgagcggttaacgcggcagcaaccgcttccggtctgcgatcgtcgtgcggtgagaactgttccaactcggggtgattatcggcatagccacctggctgcgttttcgagaaggcgctgacgttattgatcgccagcggaataacgcgatcgcgaaaccacggtgattcccgcgtggagagtgacagttcaatctccggtgcaagcagtcggaaggcgcagatggtttgcactaactggcgttcatccataatcgacgcaggctcaatgccgccagtacacgggcgcaggcgcggaaaggagacagagtaacggctttgccagtaatgctgttgcagccatagcaaatgttcggcaaccatatagcagtcaacgcgccagttgtcggaaaggccaattagcgcgccgaggcctatcttatcaatccccgcacgccccagccgatccggcgtttccagccgccagaagaagtcctgtttttttcctttcagatgatggcgggcataagtcgcctcgtgatatgtctcctgataaaccatcacgccatccagaccaagctgttttaactcggcgtattccgtctccgccagcggttgcacttccatttgtagtgaagagaactgttcacgcagggcggggagatgacgacgaaagtaatccatccccactttcgcctgatgttcaccagtgactaatagcagatgttcaaagcccatctcccgtatagcggcgctttccctggcaatatccgcttcatccagcgttttgcgcttgatgcgattactcatggaaaatccgcagtacgtgcagtcgttagcgcaaagattggaaagataaagcgggacgtagaaactaactgtgttgccaaatcgctgacgggtcagacgctgcgcccgttgggccagttgttccagatagccactggcggctggcgataacagcgccatcatatcgtcgcgggtgaattgcgaggcatttagcgcccgctctacgtcaacagccgttttgccgttgatacgcaggcggatgtcatcccagtccagttgtcgccagcgatcgctgaaggttttcatgccgatgcctccagaaatccagtcagcgggctggtggcatgagcaaaatgactgcggctgcccggtccggactgacgtgccagcaggcctgcttctaccgccagacgaaatgccttcgccatgttgacgggatcgtccgctacggcaatcgccgtattcactaacaccgcgtcggcccccatttccagcgcctgcgcggcatggctgggaacgccgatgccagcatcgacaaccaccggaactgtggcctgctggataataatctccagcatggcacgggtttccagtccctgattcgagccaatcggcgcgccgagcggcatcaccgctgcacagccgacttcttccagacgtttacacaataccggatcggccccgcagtaaggcagcacgacaaatccctgttgtaccagcatttcggcggctttcagagtttcgatgggatcgggcaacagccagcgggcgtcagggtgaatctctaattttaaccagtttgtgcctaacgcttcacgtgccagatgggcggcgaaaatggcttcttccgctgttttcgccccggaagtatttggcagcagggtcacacccgccgcgataagcggttcgaggatagcgtcgttgtgctggcgcaagtcgacacgtttcatcgccagtgtcaccagctggctgccggaagcgcggatcgcctccaccatcagttgtgaagaagcgaatttccctgtgccggtaaacagatgtgaatcaaacgttttgtccgcaatacgtaacatctcaaccccctgcaataacctgaaaaagcaggatctggtcgccatcctgcacgatatgttgcgtccactgctcacgcgggacgatttgctgattaatcgccagagccgcgcccgcttgtcgttggtcgagttgctccagtagttcgtgaacagtttgcccggcggcgcactgcatcggttgatcgttaaacaggatctgcattgcttcctccgcataccgggcaaccactggcgcggcgcaacgccaggctgcgccactggctcgatttaccgtcgaacagtcggagttctcccgcaggtgtctctataccgcttaataacttaatggcttccagtgcctgcaaagtgcccataaccccgaccaccgggccaaccacgcccgccgtgcggcagttgcgttctggctcctggttatctggccacaggcagcggtaacacccctgctcccagggcggcgtcagtaccatcaactgaccgccaaatccgaccgcgctggcggtgataagcggcgtgttgagtgccacgcaggcggcattaatctcctggcgagtcgccatattgtcggtacagtcgagcaccacatcggcccgtgcaaccgcatcttttaacgcctcacccgttaaccgttgttgtaatgctgtcagttgaatgtcgggattcaactgtgtcagtcgctgttggctgacctgcgatttcgggcgatcgatatcttcagtggtaaagaggatttgtcgttgcagattgcttaaatgcacatcgtcgtcatctgccagtaccagcgtcccgacgccagcgcccgccaggtacagcgcagcaggtgtacccagcccgccaagaccgataatcagcacctggctgtcgagcagtttttgctgcccgtcaagagcgatatcgtcgagcaggatttggcggctataacgcataaaatcacggtcattcatcgccaactcctgcaatttccagcaactgtgccgttgccaaacgccagtctgcggcttgagtaatggcgctgacgacggcgatactgccgacacccgttgctatcaccgcaggcgcgcgtgccagactgacaccgccaatcgccacggtgggataatccgccagtcgctcaacatgccgtgccagctgttccagcccctgcggtgcagaaggcatctgtttggtttgcgtcgggaacacatgtcccagcgcgatataagaggggcgtgctgccagcgcgacgtcgatttccatatcgtcatgtgtcgaaacgcccagccgcaggcctgccgcgcggatggcattgagatcggtggcttgcaaatcttcctgccccaaatggacgccatacgcctgatgcttgatcgccagccgccagtaatcgttgataaacaatcgcgcgttatagcggcggcccagcgcaattgccgccacgacatcggcttccacctcttcatcgcgccgatctttgatgcgtagctggagagtacgtacgcctgcatccaacagacgttcgatccactgtacgctgtccaccaccgggtacagtcctaaacgaaaaggtacaggaggaaaatcaggctgatacatcacgcttcctccttacgcaggtagatttctccgcctctggcacggaagttctccgacatatccgccattcccatttcaatagtttgcgtggcggcgtaatcacgcacttcctggctgattttcatcgaacagaatttcggcccacacatggagcaaaaatgggcgactttacctgactcttgcggcagggtttcatcgtgataagcgcgggcggtaaacgggtcgagggccagattaaactggtcttcccagcgaaattcgaagcgggctttcgacatggcgttatcgcgaatttgcgcgcccggatgccctttcgccaggtcagcggcgtgggcggcaatcttataggtgataagcccctgcttaacatcttctttattaggcagacccagatgctcttttggcgttacgtaacagagcatcgcgcagccaaaccagccaatcatcgccgcaccaatccccgacgtgaagtggtcatagcccggcgcaatatcggtagttagcggccccagagtgtaaaacggcgcttcgtggcagtgctctaactcctcggtcatattgcggcggatcatctgcatcggcacgtgacctgggccttcaatcatcacctgcacgtcatattcccaggcaattttggtcagttcgcccagcgtatgcagctcggcaaactgcgcttcatcgttggcgtcctgaatagaaccggggcgcagaccgtcgcccagcgacagcgaaacgtcataagcggcacagatttcacaaatttcgcggaagtgttgatagaggaaattttcctgatgatgggagaggcaccatttcgccataatcgaaccgccgcgagagacgataccggtcaggcgtttcgcggtcatcggcacatagcgcagcagtacgcccgcatggatagtgaagtaatccacaccttgctcggcctgttccagcagcgtgtcgcggaacgcttcccaggtaagatcttcggcgatcccgttaaccttctccagcgcctggtagatcggcactgtaccgatcggcaccgggctgttacgcaaaatccactcgcgggtttcgtgaatatagcgaccggtggagagatccatcaccgtatccgctccccagcgcgtggaccataccagcttttccacttcttcttcgatggaagaggtgaccgccgagttgccgatattggcgttaacttttaccaggaaattgcgaccaataatcatcggctccgattccggatgattaatgttggccgggataatcgcacgtccggcagcaacttcatcacggacaaattccgcagtgatattttccggcagatgtgcgccaaagctcattcccggatgctggtggcgtaaaacctcgctacggatgcgctcgcggcccatattctcgcggatggcgatgaattccatttccggcgtgatgatgccctggcgggcgtagtgcagttgggtgacacggcgtcctgctttggcgcgttttggtgttagtacaccgctaaaacgcagttcgtcgaggccatcatctgccagccgcgctttagtgtaatcggaactgcgcacggtaagttcttcggtatcgccgcgcgcatcgatccacggctggcgtagttttgccagcccttgctgcacgttaatggcaatctgcggatcaccatacgggccggaggtgtcgtagaccggaatcgcttcgttttcttcgtactgcggctgttctttgctaccgccaattagcgtcgggctaagctggatctcacgcatcggcacgcgcacgccggggtgtgtgccagtgatataaatgcgttttgagttgggaaaggcggtgccttccagggtgtcgataaaatgttgggcccgggcgcgttgttcgcggcgggtcagttttgttgcagacatagctcattccaaaaagttaaggacgtggcttgtcagacgacggatgaagcaagagacgatcgccgcaggggcgatgcgatagcagattaactcttgttcccttcgcaggtattagcctgatcaggttccgcggatcccgaataaacggtctcagccagttaaggcactccgacaagaaattagccccgcaaatggggcattgaatgtaaattacgcgttaacagcgcagaactcaagcaggatgtttgacgcgggcggcgtcaagcaccagcagaatcagcttatcttccagcacaaagcgcgcttccagcgcctcgccgatgtcagataaaacctgttgaaactcaaggtaattatcatgatcgatggcggtttccagactggaatcgtagtaatccataatctgttgagtattggcttcgagttgcggccaaatcttcgcggcgcgcgcgagttgcccgttgccttccagcttatgaagaatgcgctcataaatactgaaatgtccggcagacaagtaatcgaccaggctctgacaaaaatcatcaagggctttttcgtttagcctcatgtacgattctttgccaggcttaatgccaaccagattgtagtaagccacgagcagatgcttacgtacatgtagccagcgatcaaccagtttgttacttcctctgacgcgctccgtcaggttatcgagctggttaagcatgattgactccgcaagtttgtattcaaaaactgctcagtgagaaatgtaaaaaccatgttaaacatgccagtgatgcaaaggtagtgcaagagctatggatcgtataattgaaaaattagatcacggctggtgggtcgtcagccatgaacaaaaattatggttgccgaagggagaattgccatatggcgaagcggcaaatttcgatcttgtgggtcagcgcgcactacaaatcggcgaatggcagggggaacctgtttggttagtacaacagcagcggcgtcacgatatggggtcggtacgtcaggtcattgatctcgatgttgggctgtttcaactggccggacgaggcgtacaactggcggagttttaccgatcgcataaatactgtggttactgcgggcatgaaatgtatccgagcaaaaccgaatgggcgatgctgtgcagccattgccgtgagcgttactacccgcaaatcgccccctgcattattgttgccatccgtcgcgatgattcgatcctcctcgcccagcatacccgccatcgtaacggtgtccatacagtacttgccggattcgtcgaagtgggcgaaaccctcgagcaggcagtcgcgcgggaagtgatggaagagagcggaattaaagttaaaaacttgcgttacgtgacttctcagccgtggccgtttcctcagtctttaatgaccgcgtttatggcggaatatgacagcggcgacatcgtgatcgacccgaaagaattgctcgaggcgaactggtatcgctatgacgatttgccgttactcccgccgcccggcaccgtagcgcgccgtctgatagaagatacggtggcgatgtgtcgggcagagtatgagtgatgatacactgaccgcctgacgcactaaggaacagccaaaatgaccgaacttaaaaacgatcgttatctgcgggcgctgctgcgccagcccgttgatgtcactccagtatggatgatgcgccaggcgggtcgctatctaccggaatataaagccacgcgcgcccaggcgggcgattttatgtcgctgtgcaaaaacgccgagctggcgtgcgaagtgactttgcaaccgctgcgtcgctacccgctggatgcggcgatcctcttttccgatatcctcaccgtgccggacgcgatggggttagggctctattttgaagccggagaaggtccgcgttttacctcgccagtcacctgcaaagccgacgtcgataaactgccaattccggacccggaagatgagctgggttacgtgatgaacgcggtgcgtaccattcgtcgcgaactgaaaggcgaagtgccgctgattggtttttccggcagcccgtggacgctggcaacctacatggtggaaggcggcagcagcaaagccttcaccgtgatcaaaaaaatgatgtatgccgatccgcaggcgctgcacgctctactcgataaactggcgaaaagcgtcactttgtatctgaatgcgcagattaaagccggtgctcaggctgtgatgattttcgacacctggggcggcgtgcttaccgggcgcgattatcaacagttctcgctttattacatgcataaaattgttgatggtttactgcgtgaaaacgacggtcgccgcgtaccggtcacgctgtttaccaaaggcggcggacagtggctggaagccatggcagaaaccggttgcgatgcgctgggcctcgactggacaacggacatcgccgatgcgcgccgccgtgtgggcaataaagtcgcgttgcagggtaatatggatccgtcgatgctgtacgcgccgcctgcccgcattgaagaagaagtagcgactatacttgcaggtttcggtcacggcgaaggtcatgtctttaaccttggtcacggcattcatcaggatgtgccgccagaacatgctggcgtgttcgtggaggcagtgcatcgactgtctgaacagtatcaccgctaaggagtgattatggatctcgcgtcattacgcgctcaacaaatcgaactggcttcttctgtgatccgcgaggatcgactcgataaagatccaccggatctgatcgccggagccgatgtcgggtttgagcagggcggagaagtgacgcgagcggcgatggtgctgctgaaatatccctcgcttgagctggtggagtataaagttgcccgcatcgccaccaccatgccttacattccaggttttctttccttccgcgaatatcctgcgctgctggcagcgtgggagatgctgtcgcaaaagccggatttagtgtttgtcgatggtcatgggatctcgcatcctcgccgtcttggcgtcgccagccattttggtttgatggtggatgtgccaacgatcggcgtggcgaaaaaacggctctgcggtaaattcgaaccgctctccagcgaaccgggcgcgctggccccactgatggataaaggcgagcagctggcctgggtctggcgcagcaaagcgcgctgtaacccgttgtttatcgctaccggccatcgggtcagcgtggacagcgcgctggcgtgggtacaacgctgcatgaaaggctatcgtctgccggagccaacgcgctgggcggacgcggtggcctcggaacgtccggcgttcgtgcgctatacagcaaatcagccctaattcaggtaaactgcggataatttccgtatttgagaactcaacatgttacaaaacccaattcatctgcgtctggagcgcctggaaagctggcagcatgtcactttcatggcttgcttatgcgaacgcatgtaccccaattacgccatgttctgccagcaaaccggttttggtgatgggcaaatttaccgtcgcattctcgatctcatctgggaaacgctgaccgttaaagacgcaaaagtaaatttcgacagccaactggagaaatttgaagaagcgattccttcagccgacgatttcgatctgtacggcgtttatccggcaatcgatgcctgcgtggcgttaagtgaactggtccattcgcgtttgagtggtgaaacgctcgaacacgcggtggaagtgagtaagacctccatcacgaccgttgcgatgctggaaatgactcaggctggtcgcgaaatgagcgatgaagagcttaaagaaaacccagctgtagagcaagaatgggacattcagtgggaaatattccgacttttagctgagtgcgaagaacgcgatatcgagctgataaaaggccttagggcagacctgcgtgaggcgggtgagagcaatattggtataatttttcagcaataagaccagaaaacgtgatttaacgcctgatttgtcgtacctggagtcttccctttcgccccccgtctggtctacatttggggggcgaaaaaaagtggctatcggtgcgtgtatgcaggagagtgctattctggcatttccgtcgcactcgatgcttagcaagcgataaacacattgtaaggataacttatgaacaagactcaactgattgatgtaattgcagagaaagcagaactgtccaaaacccaggctaaagctgctctggagtccactctggctgcaattactgagtctctgaaagaaggcgatgctgtacaactggttggtttcggtaccttcaaagtgaaccaccgcgctgagcgtactggccgcaacccgcagaccggtaaagaaatcaaaattgccgcagctaacgtaccggcatttgtttctggcaaggcactgaaagacgcagttaagtaagattgcgtggcagtgaacagttttaacgaaggggtggtttcaccccttttgtctttctggcgtcgatcattgatgctggcaggcgctctgtttctcactgcctgtagtcacaactcttcacttcctccctttaccgccagtggatttgctgaagaccagggcgcggtacgcatctggcgaaaagacagcggcgataatgtgcatctgcttgccgtgtttagcccgtggcgcagtggcgataccacgacgcgagagtatcgctggcagggcgataacctcacgctcatcaatatcaatgtttacagcaaaccgccggtgaacattcgcgcgcgttttgacgatcgcggtgatctgagctttatgcaacgtgaatccgatggggaaaagcagcagctttctaacgaccaaatcgatttataccgttatcgtgctgatcagatccgccagattagcgatgccttacgtcaggggagagtcgtgctgcgccaggggcgctggcatgcgatggaacagaccgtgaccacctgcgaagggcaaaccattaaacctgatttagattcgcaggcgatagcgcatatcgagcgccgccagagccgctcttctgttgatgtcagcgtggcatggctggaagcgcccgaaggttcgcaattactgttagtggcaaactctgatttctgtcgctggcaacccaacgagaaaacgttctgatttaccagtggcccatacccatatgaccgccaccaccgcagccgccgtaacccatgcccattccggtaccgcgcggaatacccgcttcagccatcgcaatatctcgtttcacccgtaactcatctaacgactgacgcaaattctccatctctttggcgaccgcgttaattttgctgctatccggtgggttcgcggctaacagggcattgtattcataacgcttcgtcaccagttgctgttgcagtgcgctgctttgagcgtaaaagtcattatggattttctgccacgctgtctgttgttcgctggtcaaaggcgcggcattttgctgccacataccgtgtccgccgtgagcaaatgcagatgtcgatcccatcgccattgctgaaagcgccatcattaccagggcaattttcgtgttccgtttcatggttaatcctccagtggttgtcttacttcgggtattgcatcttccgtgccaacgatgaaacgctgatatgacgggtaatctggcatgataaacgagtaaaaatgactcgcctgctgcgggtagcgagtcatttttactcattgaaacttaagcctttgtgttacagcgcagggtaagcgctgataaaagatggcatgatttctgctgtcagaaagggatgagcaggcaaagaagaagatgcgttttatgcaacgttctaaagactccttagctaaatggttaagcgcgatcctccccgtggtcattgttgggctggtagggttgtttgcggtgacggtgattcgcgattatgggcgcgagactgccgccgccagacaaacgctgctggaaaaaggcagtgtacttattcgcgctcttgaatccggctcgcgcgtcggcatggggatgcgcatgcatcatgcgcagcagcaggccttactggaagaaatggccgggcagcctggagtacgttggtttgcggtcacggatgaacaaggaacaatcgtgatgcatagcaactccggcatggtgggaaaacagctttattccccgcaggaaatgcagcagttacatcctggagatgaagaagcgtggcggcggatcgatagcgcagacggcgagcctgttctggaaatttatcgccagtttcaaccgatgtttgctgctggaatgcaccggatgcgccatatgcagcagtatgccgcaacaccacaagcaattttcatcgctttcgacgccagtaatattgtgagtgccgaagatcgtgagcagagaaacaccctgattatcctcttcgccctggcgacggtcttgctggcaagcgtattgtcattcttctggtatcgccgctatctgcgctcgcgccagcttctacaagatgaaatgaagcgcaaagagaagctggtggcgctggggcatcttgcggcaggcgttgcccacgaaatccgtaacccactttcctcgattaaaggactggcgaaatactttgccgaacgcgcgccagcagggggagaagcgcatcaattggcgcaggtgatggcgaaagaagccgaccgtttaaaccgcgtggtaagcgagttgctggaactggttaagccaacgcatctggctttgcaggcggtggatctcaacacgctgattaaccactcattacagctggtaagccaggatgcaaacagccgggagatccagttacgctttaccgccaacgacacattaccggaaattcaggccgatccggacaggctgactcaggtcctgttgaatctctatctcaatgctattcaggcgattggtcagcatggcgtgattagcgtgacggtcagcgaaagcggcgcgggcgtgaaaatcagcgttaccgacagcggtaagggaattgcggcagatcagcttgaagccatcttcactccgtacttcaccaccaaagccgaaggcaccggattggggctggcggtcgtgcataatattgttgaacaacacggtggtacaattcaggtcgcaagccaggagggaaaaggctcaacgttcaccctctggcttccggtcaatattacgcgtaaggacccacaaggatgacgcacgataatatcgatattctggtggtggatgatgacattagccactgcactattttgcaggctttactgcgcggctggggctataacgtcgcgctggcgaacagcgggcgacaggcgctggagcaggtgcgggaacaggtttttgatcttgtgctttgcgatgtgcgaatggcggagatggacggcatcgccacgctgaaagagatcaaagcgttaaacccggcaattccggtgctgattatgactgcgtactccagcgtcgagacggcggtagaggcactgaaaactggggcgctggattatctcatcaagccgctggatttcgataacctacaggcgacgctggaaaaggcgctcgcgcatacgcacagtattgatgctgaaacacctgcggtgactgccagccagttcggtatggtcggtaaaagctcggcgatgcaacacctgctcagtgaaatcgccctcgtcgcgccatcggaagccacggtactgatccacggcgattccggcaccggtaaagagctggtcgccagggcgattcacgccagtagcgcacgtagcgaaaaaccgctggtaacgctcaactgtgcggcactcaacgaatccttgctggaatctgaattgttcggtcacgaaaaaggggcgtttactggagccgataaacgccgggaagggcgctttgttgaggcggacggcggcacgctgtttctcgatgaaattggcgatatctcgccgatgatgcaggtgcgtctgctgcgtgcgattcaggagcgcgaagttcagcgtgtcggtagcaaccagactatctcggttgatgtccggctgattgcggcgacccatcgcgatcttgccgcagaggtgaatgccgggcattttcgccaggatctctactatcgcctgaatgtggtggcgattgaagtaccatcgctgcggcaacggcgggaagatatccctctgctggctggccattttcttcagcgctttgccgagcgtaatcgcaaggcggtaaaaggctttacgccacaggcgatggatttgctgatccactacgactggccgggaaatattcgtgaactggaaaacgcggtggaacgggcggtggtgctgctgaccggggaatatatttccgaacgcgagctgccgctggcgattgccggtacgccgatcccgctggggcaaagtcaggatattcagccgctggtagaagtcgaaaaagaagtgattctggcggcactggagaaaacgggcggcaacaaaaccgaggccgcccgtcagttagggatcacgcgcaaaacgctattggcaaaactgtcgcgttagttctgctcgcgttcgatagcgcgccagccaatatctttccggcagaagcagtcgtcccagtgaatatcggtcattaaggcataagcgcgtttctgcgcttctgccacggtatgacccagcgcggtgacgcacagtacgcgcccgccgctggtcactacctgctcgttatccgccagtttcgtgcccgcgtggaacactttgccgtcagccacttcttccagcggcaggccgtggatcacatcgccggtgcggtaatcgcccggatatccacccgcagccatcaccacgccgagagaagcgcgttcatcccactcggatgttttctcgtccagcttcccttcacaggctgccaggcagagctcaaccagatcggacttcatgcgcagcataatcggctgggtttccggatcgccaaagcggcagttaaattcgataaccttcggattgccctgtttgtcgatcatcaggcccgcgtagagaaaaccggtgtaggtgttgccttccgccgccatgcctttcacggttggccagatgatacgttccatggtgcgctgatgaacttcatcggttactaccggcgcgggggagtaagcgcccatcccgcccgtgtttggtccggtatctttatcgcctacgcgtttgtgatcctggctggtagccatcggcaacacatgctcgccgtccaccatcacgataaagctcgcttcttcgccatcgaggaactcttcgataacgatgcgatgacccgcgtcgccaaaagcgttgcccgccagcatatcgtgaacagccgcttccgcttcttccagcgtcatcgccacgataacgcctttcccggcagccagaccgtccgctttaatgacgattggcgcgcctttctcacgcagatacgccagcgcaggttctacctcggtgaagttctggtattccgccgtagggatcttatggcgggccaggaaatctttggtaaacgcttttgagccttccagttgggccgcacctgcggttgggccgaagattttcagcccggcggcgcggaaggtatcgaccacgcctttcaccagcggcgcttccgggccgacgatggtcagatcaatcttttcgttttgtgcgaaatccaacagcgccgggatatcggtcacgccaatagcaacgttttgcagcgcgggttccagcgcagtgcctgcattacccggagcaacaaaaacagtctcaaccagcggcgactgggccgctttccaggccagcgcgtgctcgcgcccgccgttaccaatcactaatactttcatctattgctccattaatggcggaagtggcgcatgtcggtgaagagcatcgcaataccgtgctcgtcggcggcggcaatcacttcgtcatcacggatggaaccgccaggctggattacgcaggtcacgcccgcagcggcggcggcatcaataccgtcgcggaacgggaagaacgcgtcagaagccatcgaggaacctttcacttccaggccttcatcagcagctttaataccggcgattttcgcggagtacacgcggctcatctggcccgcgccaataccgatggtcatattgtttttggcatagacgatagcattggatttcacgaacttcgccactttccagcagaacagcgcatcgcgcagttcctgttcggtcggctgacgttgggtgacgacgcgcagttcttccgcaccgaccatccccaggtcacgatcctgaaccagcagaccgccgttcacgcgtttgaaatcaagacccggaacacgctcgccccactgaccgcaggtcagaacgcgtacgttctgcttggcggcggtgattttcagggcttcttcgctggcggaaggcgcaataatcacttcgacaaactgacgagaaatgatggcctgtgcggattccgcatccagctcgcggttaaaggcaatgatgccgccgaatgcggaggttgggtcggttttgtacgcgcgatcgtaagcatcaagaatggaattgccgatagctacaccgcaagggttggcgtgcttcacaatcacacatgccggctcggcgaactctttcacgcactccagcgccgcatcggtatcggcgatgttgttataagagagggctttaccctgaacctgggttgcggtagcaacggaggcttctttcacattctcttctatatagaaggcagcctgctggtggctgttctcgccgtaacgcatatcctgcttcttaatgaagttcaggttcagcgtgcgtgggaagcgaccagcggcttctttgctttcaccgtggtacgccggaaccatgctgccgaagtagttggcaatcatgctgtcgtaggcggcagtgtgttcgaaggctttgatggcgaggtcgaaacgggttgcaagcgtcagcgatccttcgttgtcatccatctctttaataatggcgtcgtagtcgctgctcttcaccacgattgcgacatctttatggttcttagcggcggagcgcaccatggtcgggccgccgatatcgatgttctcaaccgcatcttccagcgagcaaccttcacgggccacggtctgggcgaacggatacaggttaacaaccaccatatcgataggctggatctgatgttcttccataatggcatcgtcctggccgcgacggcccagaatgccaccatgtactttcggatgcagggtcttcacgcgtccatccatcatctccgggaaaccggtgtaatcggaaacttcggttaccggcagacctttttctgctaacagacgggcagtgccccctgtagacagcagctccacaccgcgtgcggaaagtgcctgggcgaattcgacgataccggctttgtcagaaacactgagcagagcgcggcggactggacgacgttgttgcatggtaaatcccctggatttgactattacagagagcgttagctgaatttttcgcgaaaaactcagctaacgcccctaacggggcatccttatttttcgcccgcattgtaacgaaaacgtttgcgcaacgctcgcgaatttttctctttcaatggtgatcacaattttgacagtggttaccgtgggaaaaatacagaaattacattgatgattgtggataactctgtgcgtaaaaaggtataaagcggggttttgctggggaatgcagcagtcagtcatttttctgcaatttttctattgcggcctgcggagaactccctataatgcgcctccatcgacacggcggatgtgaatcacttcacacaaacagccggttcggttgaagagaaaaatcctgaaattcagggttgactctgaaagaggaaagcgtaatatacgccacctcgcgacagtgcgctaaagcgcgtcgcaactgctctttaacaatttatcagacaatctgtgtgggcactcgaagatacggattcttaacgtcgcaagacgaaaaatgaataccaagtctcaagagtgaacacgtaattcattacgaagtttaattctttgagcatcaaacttttaaattgaagagtttgatcatggctcagattgaacgctggcggcaggcctaacacatgcaagtcgaacggtaacagaaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagcttgttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgttctttgaagtgctcacacagattgtctgatagaaagtgaaaagcaaggcgtcttgcgaagcagactgatacgtccccttcgtctagaggcccaggacaccgccctttcacggcggtaacaggggttcgaatcccctaggggacgccacttgctggtttgtgagtgaaagtcacctgccttaatatctcaaaactcatcttcgggtgatgtttgagatatttgctctttaaaaatctggatcaagctgaaaattgaaacactgaacaacgagagttgttcgtgagtctctcaaattttcgcaacacgatgatgaatcgaaagaaacatcttcgggttgtgaggttaagcgactaagcgtacacggtggatgccctggcagtcagaggcgatgaaggacgtgctaatctgcgataagcgtcggtaaggtgatatgaaccgttataaccggcgatttccgaatggggaaacccagtgtgtttcgacacactatcattaactgaatccataggttaatgaggcgaaccgggggaactgaaacatctaagtaccccgaggaaaagaaatcaaccgagattcccccagtagcggcgagcgaacggggagcagcccagagcctgaatcagtgtgtgtgttagtggaagcgtctggaaaggcgcgcgatacagggtgacagccccgtacacaaaaatgcacatgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagcacgcttaggcgtgtgactgcgtaccttttgtataatgggtcagcgacttatattctgtagcaaggttaaccgaataggggagccgaagggaaaccgagtcttaactgggcgttaagttgcagggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaagctatttaggtagcgcctcgtgaactcatctccgggggtagagcactgtttcggcaagggggtcatcccgacttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgacgcttatgcgttgttgggtaggggagcgttctgtaagcctgcgaaggtgtgctgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacaggttaatattcctgtacttggtgttactgcgaaggggggacggagaaggctatgttggccgggcgacggttgtcccggtttaagcgtgtaggctggttttccaggcaaatccggaaaactaaggctgagacgtgatgacgaggcactacggtgctgaagcaacaaatgccctgcttccaggaaaagcctctaagcatcaggtaacatcaaatcgtaccccaaaccgacacaggtggtcaggtagagaataccaaggcgcttgagagaactcgggtgaaggaactaggcaaaatggtgccgtaacttcgggagaaggcacgctgatatgtaggtgaagtccctcgcggatggagctgaaatcagtcgaagataccagctggctgcaactgtttattaaaaacacagcactgtgcaaacacgaaagtggacgtatacggtgtgacgcctgcccggtgccggaaggttaattgatggggtcagcgcaagcgaagctcttgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggcttggaagtgtggacgccagtctgcatggagccgaccttgaaataccaccctttaatgtttgatgttctaacgttgacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgactccttgagagtcctgaaggaacgttgaagacgacgacgttgataggccgggtgtgtaagcgcagcgatgcgttgagctaaccggtactaatgaaccgtgaggcttaaccttacaacgccgaagctgttttggcggattgagagaagattttcagcctgatacagattaaatcagaacgcagaagcggtctgataaaacagaatttgcctggcggccttagcgcggtggtcccacctgaccccatgccgaactcagaagtgaaacgccgtagcgccgatggtagtgtggggtctccccatgcgagagtagggaactgccaggcatcaaattaagcagaaggcccagtcggaagactgggcctttttgcgctggtgcagaaaaaggtcggatgcgacgctggcgcgtcttctccagcctgggcaggcacggcaggggcggcttattcccccacatacgccagattcagcaacggatacggtttccccaaatcgtccacctcagagcgtcccgtaaccttaaaacccaccttcttatagaacccaaccgcctgctcattttgctcattaacgttggttgtcagttccggtgccatcgagagcgcatgctccaccagcatccgacccacgccgcagccgcgcacatcaggatcgataaacagcgcatccatatgctgcccacttaacaacataaacccaaccggctgatcccgttcattaaccgcgacccacaacggtgcttccggcagaaaggaacgaaccagctcttccagctcggcccgatactctgctgataaaaaatcgtgggtggcatcgacagatcgacaccaaatcgcaacgagttcctccccttcctcatgctgtgagcggcgaatactaataaccattttctctccttttcgtcattcttatattctaacgtagccttttccttgaaactttctcaccttcaacatgcaggctcgacattggcaaattttctggttatcttcagctatctggatgtctaaacgtataagcgtatgtagtgaggtaatcaggttatgcctattcgtgtgccggacgagctacccgccgtcaatttcttgcgtgaagaaaacgtctttgtgatgacaacttctcgtgcgtctggtcaggaaattcgtccacttaaggttctgatccttaacctgatgccgaagaagattgaaactgaaaatcagtttctgcgcctgctttcaaactcacctttgcaggtcgatattcagctgttgcgcatcgattcccgtgaatcgcgcaacacgcccgcagagcatctgaacaacttctactgtaactttgaagatattcaggaacagaactttgacggtctgattgtaaccggtgcgccgctgggcctggtggagtttaatgatgtcgcttactggccgcagatcaaacaggtgctggagtggtcgaaagatcacgtcacctcgacgctgtttgtctgctgggcggtacaggccgcgctcaatatcctctacggcattcctaagcaaactcgcaccgacaaactctctggcgtttacgagcatcatattctccatcctcatgcgcttctgacgcgtggctttgatgattcattcctggcaccacattcgcgctatgctgactttccggcagcgttgattcgtgattacaccgatctggaaattctggcagagacggaagaaggggatgcatatctgtttgccagcaaagataagcgcattgcctttgtgacgggccatcccgaatatgatgcgcaaacgctggcgcaggaatatttccgcgatgtggaagccggactaggcccggaagtaccgtataactatttcccgcacaatgatccgcaaaatacaccgcgagcgagctggcgtagtcacggtaatttgctgtttaccaactggctcaactattacgtctatcagatcacgccatacgatctacggcacatgaatccaacgctggattaatcttctgtgatagtcgatcgttaagcgattcagcaccttacctcaggcaccttcgggtgccttttttatttccgaaacgcacctcaggaggtgaataaattttattcatattgttatcaataagttatcaagtatttttaattaaaatggaaattgtttttgattttgcattttaaatgagtagtcttagttgtgctgaacgaaaagcgcacaacgatccttcgttcacagtggggaagttttcggatccatgacgaggagctgcacgatgactgaacaggcaacaacaaccgatgaactggctttcataaggccgtatggcgagcaggagaagcaaattcttactgccgaagcggtagaatttctgactgagctggtgacgcattttacgccacaacgcaataaacttctggcagcgcgcattcagcagcagcaagatattgataacggaactttgcctgattttatttcggaaacagcttccattcgcgatacggactggaaaattcgtggtattcccgcggacttacaagatcgtcgagtcgagataactggcccggttgagcgcaagatggtgatcaacgcactgaacgccaatgtgaaagtctttatggccgatttcgaagattcactggcaccagactggaacaaagtgatcgacgggcaaattaacctgcgcgatgcggttaacggcaccatcagctataccaatgaagcaggcaaaatttatcagctcaagcccaatccagcggttttgatttgtcgggtacgcggtctgcacttgccggaaaaacatgtcacctggcgtggtgaggcaatccccggtagcctgtttgattttgcgctctatttcttccacaactatcaggcactgttggcaaagggcagcggtccctatttctatctgccgaaaacccagtcctggcaggaagcggcctggtggagcgaagtcttcagctatgcagaagatcgctttaatctgccgcgcggcaccatcaaggcgacgttgctgattgaaacgctgcccgccgtgttccagatggatgaaatccttcacgcgctgcgtgaccatattgttggtctgaactgcggtcgttgggattacatcttcagctatatcaaaacgttgaaaaactatcccgatcgcgtcctgccagacagacaggcagtgacgatggataaaccattcctgaatgcttactcacgcctgttgattaaaacctgccataaacgcggtgcttttgcgatgggcggcatggcagcgtttattccgagcaaagatgaagagcgcaataaccaggtgctcaacaaagtaaaagcggataaagcgctggaagccaataacggtcacgatggcacatggattgctcacccaggccttgcggatacggcaatggcggtattcaacgacattctcggctcccgtaaaaatcagcttgaagtgatgcgcgaacaagacgtgccgattactgccgatcagctgctggcaccttgtgatggtgaacgcaccgaagaaggtatgcgcgccaacattcgcgtggcagtgcagtacatcgaagcatggatctccggcaacggctgcgtgccgatttatggcctgatggaagatgcggcgacggctgaaatttcccgtacctcaatctggcagtggatccatcatcaaaaaacgttgagcaatggcaaaccggtgaccaaagccttgttccgccagatgctgggtgaagagatgaaagtcattgccagcgaactgggcgaagaacgtttctcccaggggcgttttgacgatgccgcacgcttgatggaacagatcaccacttccgatgagttaattgatttcctgaccctgccaggctaccgcctgttagcgtaaaccaccacataactatggagcatctgcacatgaaaacccgtacacaacaaattgaagaattacagaaagagtggactcaaccgcgttgggaaggcattactcgcccatacagcgcggaagatgtggtgaaattacgcggttcagtcaatcctgaatgcaccctggcgcaactgggcgcggcgaaaatgtggcgtctgctgcatggcgagtcgaaaaaaggctacatcaacagcctcggtgcactgactggcggtcaggcgctgcaacaggcgaaagcgggtattgaagcagtctatctgtcgggatggcaggtagcggcggacgctaacctggcggccagcatgtatccggatcagtcgctctatccggcaaactcggtgccagctgtggtggagcggatcaacaacaccttccgtcgtgccgatcagatccaatggtccgcaggcattgagccgggcgatccgcgctatgtcgattacttcctgccgatcgttgccgatgcggaagccggttttggcggtgtcctgaatgcctttgaactgatgaaagcgatgattgaagccggtgcagcggcagttcacttcgaagatcagctggcgtcagtgaagaaatgcggtcacatgggcggcaaagttttggtgccaactcaggaagctattcagaaactggtcgcggcgcgtcttgcagctgacgtgacgggcgttccaaccctgctggttgctcgtaccgatgccgatgcggcggatctgattacctccgattgcgacccgtatgacagtgaatttattactggcgagcgtaccagtgaaggcttcttccgtactcatgcgggcattgagcaagcgatcagccgtggcctggcgtatgcgccatatgctgacctggtctggtgtgaaacctccacgccggatctggaactggcgcgtcgctttgcacaagctatccacgcgaaatatccgggcaaactgctggcttataactgctcgccgtcgttcaactggcagaaaaacctcgacgacaaaactattgccagcttccagcagcagctgtcggatatgggctacaagttccagttcatcaccctggcaggtatccacagcatgtggttcaacatgtttgacctggcaaacgcctatgcccagggcgagggtatgaagcactacgttgagaaagtgcagcagccggaatttgccgccgcgaaagatggctataccttcgtatctcaccagcaggaagtgggtacaggttacttcgataaagtgacgactattattcagggcggcacgtcttcagtcaccgcgctgaccggctccactgaagaatcgcagttctaagcaacaacaaccgttgctgactgtaggccggataaggcgttcacgccgcatccggcaatcggtgcacgatgcctgatgcgacgcttgcgcgtcttatcatgcctacagccgttgccgaacgtaggccggataaggcatttacgccgcatccggcaatcggtgcacgatgcctgatgcgacgcttgcgcgtcttatcatgcctacaaccgttgccgaacgtaggctggataaggcgtttacgccgcatccggcaattctctgctcctgatgagggcgctaaatgccgcgtggcctggaattactgattgctcaaaccattttgcaaggcttcgacgctcagtatggtcgattcctcgaagtgacttccggggcgcagcagcgtttcgaacaggccgactggcatgctgtccagcaggcgatgaaaaaccgtatccatctttacgatcatcacgttggtctggtcgtggagcaactgcgctgcattactaacggccaaagtacggacgcggcatttttactgcgcgttaaagagcattacacgcggctgttgccggattacccgcgcttcgagattgcggagagcttttttaactccgtgtactgtcggttatttgaccaccgctcgcttactcccgagcggctttttatctttagctctcagccagagcgccgctttcgtaccattccccgcccgctggcgaaagactttcaccccgatcacggctgggaatctctactgatgcgcgttatcagcgacctgccgctgcgcctgcgctggcagaataaaagccgtgacattcattacatcattcgccatctgacggaaacgctggggacagacaacctcgcggaaagtcatttacaggtggcgaacgaactgttttaccgcaataaagccgcctggctggtgggcaaactgatcacgccttccggcacgttgcccttcttactgccgatccaccagacggacgacggcgagttatttattgatacctgcctgacgacgaccgccgaagcgagcattgtttttggctttgcgcgttcttattttatggtttatgcaccgctgcccgcagcgctggtcgagtggctacgggaaattctgccaggtaaaaccactgctgaattgtatatggctatcggctgccagaagcacgccaaaaccgaaagctaccgcgaatatctcgtttatctacagggctgtaatgagcagttcattgaagcgccgggtattcgtggaatggtgatgttggtatttacgctgccgggctttgatcgggtattcaaagtcatcaaagacaagttcgcgccgcagaaagagatgtctgccgctcacgttcgtgcctgctatcaactggtgaaagagcacgaccgtgtgggccgaatggcggacacccaggagtttgaaaactttgtgctggagaagcggcatatttccccggcattaatggaattactgctccaggaagcagcggaaaaaatcaccgatcttggtgagcagattgtaattcgccatctctatatcgagcggcggatggtgccgctcaatatctggctggaacaagtggaaggtcagcagttgcgcgacgccattgaagaatacggtaacgctattcgccagcttgccgctgctaacatttttcctggcgacatgctgtttaaaaacttcggtgtcacccgtcacgggcgtgtggttttttatgattacgatgaaatttgctacatgacggaagtgaatttccgcgacatcccgccgccgcgctatccggaagacgaacttgccagcgaaccgtggtacagcgtctcgccgggcgatgttttcccggaagagtttcgccactggctatgcgccgacccgcgtattggtccgctgtttgaagagatgcacgccgacctgttccgcgctgattactggcgcgcactacaaaaccgcatacgtgaagggcatgtggaagatgtttatgcgtatcggcgcaggcaaagatttagcgtacggtatggggagatgcttttttgagtaaagcttccatataatttttctccgcaatgtatcgagggttatccgtaaagccaaagctttcagccatcttatttaatgtattaaggattaattcagcaataacccggtgacccaattcaaaagccaactcaaaggcagagtatttttgtggggctttgtgttgccaaaaatccataatatcttcagcggtaaatccaaacaggcgtgcatggtcagataaagcaagataaaccgtctctacaacgttttgttgtttatgctgtatcgctgaaaacaaaccgggatattcattagaattatttgccaggaggaggggcttcatatttttttatcgaatttaaacgtattaaaaagagtgggtaatgcgttaaaaatagtattaataacgttcatatgtccactattataggcagtcaacatttctgttctatgtagttctggcattttctggagttgaatcatcagttgcgtaagttggtgattctgaccaattgccattagcaaattcatcgttgcaggtgataatggaggggttatttcatccacagatccttttaacatcaatagctgttctttcggaagtgctggaattattgcaacagattggttaataatatgatcatttgaccatttcaggaggctataatctacattcataaaatccatcagagaatagtgtttaatatcctctttgctttcgctcataattcttattttatcgttagtgacattaggatcataaaccgaaaccacgtaatgggtacatccttcagttgtgttctttattcttagccgcgccgtcaaagcatggttatccaccaataatatggctgccataacactgatgccatttgattccatcttgtcgaaatatgccttcataactagcccgaaatcaccacaggcagcaacgcaacgctcctcaggacggctggaaaccaacgccaaagtctggtttttgcattttttgttgaagtgcgtgagaaatttttcagctgaagagtaatcatcttgatggggtttgtaatcaacattctgataaatatcattaatatattgtgcagcaatgtgtcggcatactatacggttttggggtcgccccggaaaataacattgaccattaagtttaattcttgggaattctttttcttttctatctgattttaggtttaattcttgtttatcaagagtgtctgagcgttgaggtaaaatttccattaggtattcttcaaatattggggcaatggtttgagtaagtgtcgtgttttcgtttttattaattatcgtaatttctttcttatcagcttgtaagacggacgtggaaaatttaatgacaaaatccttgttgctaaagatatgacgaccattttgtctacagttctctgagaagctttttaatagaggcgtcgccagctccttgccagaaaatttatcctcgagttctttataaaacaattcactcagggtttggtgttcatttgtctgggctgtattattaatatttgcagagaaagaactacgagggatacgagtaatcatttaaatatctcattgtttattgatgtcttgaattttaattatcagaacagtgaaaaaatttaatatgattacaactaaagaaatatcataaatcgctcaatctcataatgcagccgtaaaagtttcggtggaatgagatcttgcgattttgttaatgattaagtggtttgatgtttaaaaataatgctgagttaataaaagtgtgtgaagtgtatgacattaagttattttggcgtcaatgcgattaacagacacccttattctattgccactcaggtatgatgggcagaatattgcctctgcccgccagaaaaagtcagcgcattccaccgtacgccagcgtcacttccttcgccgctttaatcaccatcgcgccaaactcggtcacgcggtcatcggtaatacgtgaaatcggtccggaaattgaaattgcggcaaacggttcgcggtgctcatcgaaaatacacgctgcaaggcaacgtagccccagtgcatgttcctcatcgtcaaatgaataaccccgtttgcgcgtttgggcgagatcttcttttaaatgcacaggagacaccagcgttgcgtgggtataggcatgtaaccctttgcggtgcagcagcttcgtcacctgttcttcgctcagttgggctaaaaaggctttacccgcaccggaagcgtgcatcggcaatttaccgccgataggcgcggacattcgcatcagatgcgtacactgtacctggtcgataataatcgcttcgtgatcgctttgatcaagcaccgccatattgaccgtttcgccagactcttccattaaattgcgcaggatagggtgaacaatcgctaacaaattacggctctggagaaagctgctgccgaccataaaggcatgtgcgccgattgcccaatgtcccagttcgccgacctgacgcacgaaaccctgctgttgcatcgtggttagcaggcggtgggtcgtggaattgggtaacccggcttgttgcgccagctctgtgagtgccacactgccattggattcggcaatccactccagtaatttcaggccacgcgttaaagactgaacctgtccagtcgctggtgcggtggcaacggcgggttttctgccgcgtttcgcgggaatgggtgcgaccatgacagcctcctttttctgtatcgtggaaatcattttcatttttattgttagctaatgcaatagttgctgaactgatccgatgagttaatgttgaacaaatctcatgttgcgtggtggtcgcttttaccacagatgcgtttatgccagtatggtttgttgaatttttattaaatctgggttgagcgtgtcgggagcaagtgtgagcagcaaagtggaacaactgcgtgcgcagttaaatgaacgtattctggtgctggacggcggtatgggcaccatgatccagagctatcgactgaacgaagccgattttcgtggtgaacgctttgccgactggccatgcgatctcaaaggcaacaacgacctgctggtgctcagcaaaccggaagtgatcgccgctatccacaacgcctactttgaagcgggcgcggatatcatcgaaaccaacacctttaactccacgaccattgcgatggcggattaccagatggaatccctgtcggcggaaatcaactttgcggcggcgaaactggcgcgagcttgtgctgatgagtggaccgcgcgcacgccggagaaaccgcgctacgttgccggtgttctcggcccgaccaaccgcacggcgtctatttctccggacgtaaatgatccggcatttcgtaatatcacttttgacgggctggtggcggcttatcgagagtccaccaaagcgctggtggaaggtggcgcggatctgatcctgattgaaaccgttttcgacacccttaacgccaaagcggcggtttttgcggtgaaaacggagtttgaagcgctgggcgttgagctgccgattatgatctccggcaccatcaccgacgcctccgggcgcacgctctccgggcagaccaccgaagcattttacaactcattgcgccacgccgaagctctgacctttggcctgaactgtgcgctggggcccgatgaactgcgccagtacgtgcaggagctgtcacggattgcggaatgctacgtcaccgcgcacccgaacgccgggctacccaacgcctttggtgagtacgatctcgacgccgacacgatggcaaaacagatacgtgaatgggcgcaagcgggttttctcaatatcgtcggcggctgctgtggcaccacgccacaacatattgcagcgatgagtcgtgcagtagaaggattagcgccgcgcaaactgccggaaatccccgtagcctgccgtttgtccggcctggagccgctgaacattggcgaagatagcctgtttgtgaacgtgggtgaacgcaccaacgtcaccggttccgctaagttcaagcgcctgatcaaagaagagaaatacagcgaggcactggatgtggcccgccagcaggtggaaaacggtgcgcagattatcgatatcaacatggatgaagggatgctcgacgccgaagcggcgatggtgcgttttctcaatctgattgccggtgaaccggatatcgctcgcgtgccgattatgatcgactcctcaaaatgggatgtcattgaaaaaggtctgaagtgtatccagggcaaaggcattgttaactctatctcgatgaaagagggcgtcgacgcctttatccatcacgcgaagctcttgcgtcgttacggtgcggcagtggtggtaatggcctttgacgaacagggacaggccgatacccgcgcacggaaaatcgagatttgccgtcgggcgtacaaaatcctcaccgaagaggttggcttcccgccagaagatatcatcttcgacccgaacatcttcgcggttgccaccggcattgaagagcacaacaactacgcgcaggactttatcggcgcgtgtgaagacatcaaacgcgaactgccgcacgcgctaatttccggcggcgtatctaacgtttctttctcgttccgtggcaacgatccggtgcgcgaagccattcacgcagtgttcctctactacgctattcgcaatggcatggatatggggatcgtcaatgccgggcagctggcgatttacgacgacctgcccgctgaactgcgcgacgcggtggaagatgtgattcttaatcgtcgcgatgatggcactgagcgtttactggagcttgccgagaaatatcgcggcagcaaaaccgatgacaccgctaacgcccagcaggcggagtggcgctcgtgggaagtgaataaacgtctggaatactcgctggtcaaaggcattaccgagtttatcgagcaggataccgaagaagcccgccagcaggctacgcgcccgattgaagtgattgaaggcccgttgatggacggcatgaacgtggtcggcgatctgtttggcgaagggaaaatgttcctgccacaggtggtcaaatcggcgcgcgtcatgaaacaggcggtggcgtatctcgaaccgtttattgaagccagcaaagagcagggcaaaaccaacggcaagatggtgatcgccaccgtgaagggcgacgtccacgacatcggtaaaaatatcgttggtgtggtgctgcaatgtaacaactacgaaattgtcgatctcggcgttatggtgcctgcggaaaaaattctccgtaccgctaaagaagtgaatgctgatctgattggactttcggggcttatcacgccgtcgctggacgagatggttaacgtggcgaaagagatggagcgtcagggcttcaccatcccgctattgattggcggcgcgacgacctcaaaagcgcacacggcggtgaaaattgagcagaactacagcggcccgacggtgtatgtacagaacgcatcgcgcaccgttggtgtggtggcggcgctgctttccgatactcagcgtgatgattttgtcgctcgtacccgcaaggagtacgaaaccgtacgtattcagcacgggcgtaagaaaccgcgcacaccaccggtcacgctggaagcggcgcgcgataacgatttcgcttttgactggcaggcttacacgccgccggtggcgcaccgtctcggcgtgcaggaagttgaagccagcatcgaaactctgcgtaattacatcgactggacaccgttctttatgacctggtcgctggccgggaagtatccgcgcattctggaagatgaagtggtgggcgttgaggcgcagcggctgtttaaagacgccaacgacatgctggataaattaagcgccgagaaaacgctgaatccgcgtggcgtggtgggcctgttcccggcaaaccgtgtgggcgatgacattgaaatctaccgtgacgaaacgcgcacccatgtgatcaacgtcagccaccatctgcgtcaacagaccgaaaaaacgggattcgctaactactgtctcgctgacttcgttgcgccgaagctttctggtaaagcagattacatcggcgcatttgccgtgactggcgggctggaagaggacgcactggctgatgcctttgaagcgcagcacgatgattacaacaaaatcatggtgaaagcgcttgccgaccgtttagccgaagcctttgcggagtatctccatgagcgtgtgcgtaaagtctactggggctatgcgccgaacgagaacctcagcaacgaagaactgatccgcgaaaactaccagggcatccgtccggcaccgggctacccggcctgcccggaacatacggaaaaagccaccatctgggagctgctggaagtggaaaaacataccggcatgaaactcacagaatctttcgccatgtggcccggtgcatcggtttcgggttggtatttcagccacccggacagcaagtactacgccgtggcgcaaattcagcgcgatcaggttgaagactatgcccgccgtaaaggtatgagcgtctcagatgttgagcgctggctggcaccgaatctggggtatgacgcggactgattcacaaatctgtcacttttccttacaacaaacagggcgctcaatgagtgccctgtctctttattaatatgaaacacttatactggaatcaggctggaataatcttagccggaaaaacgaatgtcaaaaggcacaataaagatgccagtcagcgtgtttccggtcctttggtcattcaattgcttcaggcacatataacgataaggagaacctgaactcgtgttaacgctgcttcacctgctttctgccgtcgccctgctggtctgggggactcatattgttcgaaccggcgtaatgcgcgtcttcggcgcgcgtttgcgtactgtccttagccggagcgtcgaaaaaaagccgctcgccttttgcgcggggatcggcgttaccgcactggtgcagagcagtaatgccaccaccatgctggtgacctcgtttgtcgctcaggatctggtagccctcgcaccggctctggtcattgtgctgggtgcagatgtcgggacggcgctaatggcgcgtattctcaccttcgacttatcctggctgtcaccgttacttatttttatcggcgtgatttttttcctcggacgcaaacagtcacgcgccgggcaactgggccgcgtcggtattggtcttgggctgattttgctggcgctggagttgattgtgcaggccgtaacgccgatcacccaggcaaacggcgttcaggtgatctttgcctcgctgaccggcgatattctgctggatgcgctgattggcgcgatgttcgccattatcagctactccagccttgctgctgtactgctgactgcgactctgaccgccgcaggcattatctccttccccgtggcgctctgtctggtgattggtgctaacctcggttccggtctgctggcgatgctcaacaacagtgccgccaatgccgcagcccgccgtgtcgcgctgggtagtctgctgtttaagctggtgggtagcctgattatcctgccgtttgtccatttgctggcagagacaatggggaagctgtcattgccaaaagcggaactggtgatctatttccacgtcttctacaaccttgtacgttgcctggtcatgctgccatttgttgacccgatggcacggttttgcaaaacgattattcgcgatgaaccggaactggatacccagctacggcctaaacatctggatgtcagcgcgctggatacgcccacgcttgctctggcgaacgccgcgcgcgaaaccctgcgcattggcgacgccatggaacagatgatggaagggttgaataaagtgatgcacggtgagccacggcaggagaaagagctgcgtaagctggcagatgatatcaacgttctctacaccgccattaagctgtatctggcgcggatgccaaaagaagagctggcggaggaagagtcgcgccgctgggcagagatcatcgaaatgtcgctcaaccttgaacaggcctccgatatcgtcgagcgcatggggagtgaaattgccgacaaatcactggcagcacggcgggcattttcgcttgatgggttgaaggaactggatgcgctctatgagcaattgctcagtaatttaaagctggcaatgtcggtgttcttctctggcgatgtcaccagcgctcgtcgtttgcgccgtagtaagcatcgctttcgcattcttaatcgccgctattcccatgcccacgtcgatcgcctgcatcagcaaaacgtgcagagcattgaaaccagttcgctacatttaggcttactgggagatatgcagcgcctgaactcgctgttttgttcggtggcttacagtgtgctggaacagccggatgaagatgaaggacgggacgagtattaatattgtgaatcctgtaggcctgataagacgcgtcaagcgtcgcatcaggcactatgaacaagatgccggatcatgcatccggcaattcacttaaaaacggtgaccagcttctagcggcaccgcttcttcaccagccttaaacacataagtggtgttcgggccacccagcgtagcgtgacctttactcactgtgatccagttaccttccggtagaccaataatcgtcagttctggcgcgacgaccagcagttcgcgaatacgctgctcacgggtttcacctttatggccttccggcagcgcgttggtgaagtgcgggttgatttgcaacgggaacagatttagcgcatcgaaaccttgcggatcgacaatcggcatatcgttggtggtacgaatggttgggcaagcaaggttagcgcctgcgctccagccaatatacagagcgccacgtttaaccacgtcagtaattggtgccagcagcccgcgctcgcggcactgtttcagcaactggaaagtattcccgccgccgacaatcacgatctcagcattttcaatcgcggcaacgggatcgacaacgctatgaataccggtgacagaaacacccagcggagcgagaaccgcagccgttttcgctgtgtaatcatcccaggtctgcgttacgccagcgaaagggataaacaccgctgagcggcgaccctgcaactgttcagcaattagcggcagtgcatgttccagccaggctttacccggcagcgtcgagttactcaataaaagcagttccattacttctccggttagtaagaaatcacgggaggcatgctaccactgcgaatttaaccacttactgacatggctcacgatgtcgcacattgcttctggaaagtgatttgagcaggtaacgaattcaagccaatggaaataacaaatagttcgctcatgactattttttatcaacccaaaggtacggtatattccgttttttacaggagaatttatgctgcccgactcatcagtccgtttaaataaatacatcagcgaaagcggaatttgctcacgccgcgaagcggatcgctatatcgagcaaggcaatgtgttccttaatggcaagcgagccaccattggcgatcaggtgaaacccggcgacgttgtgaaagtaaacggtcagttgattgagcctcgggaagccgaagatttggtacttatcgccctgaacaagcccgtcggtattgtcagcaccaccgaagatggcgagcgcgataacattgtcgatttcgttaaccacagcaaacgcgtgttcccgattggccgcctggataaagactcccaggggctgattttcctcaccaatcacggcgatctggtgaataagatcctccgtgcgggtaacgatcatgagaaagagtatctggttacggtcgataaaccgattaccgatgaatttattcgtggtatgggggcgggggtgccaatcctcgggacagtgactaaaaagtgtaaagtcaaaaaagaagcgccgtttgtcttccgcattaccctggtgcaggggctgaaccgtcagatccggcgcatgtgcgagcatttcggctatgaagtgaaaaagctggaacgtacgcgcattatgaacgtcagcttaagcggcattccgctgggtgagtggcgcgatttaactgacgatgagttaatcgacctgtttaaactcattgaaaattcctcttccgaggtaaaacctaaagcgaaggctaaaccgaaaacagcgggcatcaaacgtccagtcgttaagatggaaaaaacggcggaaaaaggcggtcgcccggcgtccaacggtaagcgttttacctcgccggggcgtaaaaagaagggacgctgattaacgcctcagactgatgaaaacgtccaaaaagagctcggacagtcccctcgccccttcggggagagggttagggtgaggggaagattgtgtccacacagacgagtgaaaatctcaggcgttgattgttcattagcgcctgccgcgcgtcgacgtatttgctgaccagctaaatgacgcttcaggatccggtttataagcctgctttttcttcaattggcgggcttttttcgcttcagcctcacgctcgaccattaatttatcgatgtactctttcttaatgctgttggtttcggagttggtcagtacgcgaccatgcgcaatccgcgcccgatccagcagtgttttaagttcacgctgctcgcgttcagtcatctctttttgggtaatacgggggagtgccatgatggtgccctcagtgagccagagagttcagtgtacgggaattcgtttgcgagctgaactgataatattcctttgttctcttcttaaatatttatctttcttgataattgacgataaatacagatacaaatttagcgaaaagttttccctctacaaacaaaaataatttattaaatctttatttttcatttggttaataattttttctcaattctggcacgcttctcgcaatatctcgtacgcgttgaaactgaattacaaagggggtcaaaccccgtcggcacaccaagaacggccaggctgttttccgggcgtgttccgtcagcctttgacgccaattatgggttcgattcccacattcattcctgaaatgaatactggttttaacttattaaataaaaagtgagggattgcgcagtcagcgatccccgataacgtcgccgataaagatgccgggtaacaggcaaaagggaattcccctgtcgcttcgtgtctgcttccgcgacggctgttaagcaaggaatagataatgattaaaaaaataagcgtaagaaaagatcagctggcattactctccagaaacggcgattactacaaagtgctacatgcaggcgagcatcttttaccctggttaaatacgccagaagtcttgctgattacgctcgatggcagcgaagttcccgacgtgctggcggattatttgcgccgctttcagcctgattgggtggagaaatattgcctggtggcagacttgtcggagattgaagccggggcgttgtatatggacggtattttgcaggagatcctgccgccatcaacgcgccgtttgtactggcgtgtagaggatgatttgacactggtgcggatgaatacgcagcaagtccaggtacaaacggaggtgatgaatgcggtattgcaaccacggcgcaaaggggcagttaaaggccgcgatgcaatactaacggtgcaggttccggcctggcatgtaggcgtgctgaaaatcgatggtgaaacgcaggcgctgttaccgccggggctgaccgcatactggaaaattaaccatctggttgacgctgaagtggttgacacccgcttgcaggtactggaagtcagcgggcaagaaatcttaacgaaagataaggtcaatctgcggattaacctcgccgctaactggcgctacagcgacgtgttgctggcatttagtcagttaacgaagccgattgatcatttgtatcgggaattgcaatttgccctgcgtgaagcggtaggtactcgtacgctggatgaactgctggaagataaacaggtcattgatgacgttgtcagcgaacaggtgaaatcgcgcatgttgccatttggtatggagattgcctcattaggggtgaaagatatcgtcctgcctggtgatatgaaaaatatcctcgcgcagctggttgaggcagagaaatctgcgcaggcgaatgtgattcgccgacgtgaagaaacggcagcgacgcgctcgttactgaacaccgccaaagtcatggagaacaatccggtagcgttgcgtttaaaagagctagaaacgctggagagagtggctgagcggatcgataacatctctgtatttggcggtctggatcaggttctgcatgggttggttaatatcaaagggtgagtaacatgccattaaatggagtcagtgctgcgatgcgcgaaagggtatcgcagcagttaaaagaaattgaacggcggtatgatgtgaaagtactgtacgcctgtgaatcagggagccgcggctggggatttgcctcgcccgacagcgactacgatgtacggtttttgtatgttcacccgctggaatggtatctgcgagtagagtcaccgcgcgatgttattgagctgcccatcgacgacgagttagatgtttccggttgggagtggcgtaaggcgctgggattattgaaaggcgcgaacccgacgctgatagaatggctggattctccggtgatttatcaacaagatgaagaaacgataacggcgtttaaggcaatggtcccaatgtggttttctccgctgcgtgcgcgctggcattactattcgatggcgcagaaaaacttccccggatatttgcagggcgacgaagttcgactgaaaaaatacttttacgtgctgcgtccgctgctggccgtgcgctgggtcgaagcgggtaaaggcgtaccgccaatgcgctttgctgagttactggcgggaagcgaacttgatgcgccgttacgtgcagaaatagacgaattactggaacgtaaacagcgcgcaggagaagcggaatatggtccgcgccgtccattgttacatgcgtttattcgtgcggaacaggcgcgtggggaaattccaccgctgttaccggatagcagagaaggggacgttaaggaactggatagcttaatgtaccagacggtaatgcgccgggcataaagcccggcgttatttcacgccatcagctcttattattattgtgtattcccgctgatttcattctgtataagtgttgcaatatcgtcattcgttgccgcttgtgaactaaatatcatcttctcacgcgaatacaccgcaaacttatctgacaggttcgaagcaaacaccttgcgggcattttctgccagcaaaccggtgacgatatcatggtggtttttatccacttttcgggcaatatttcccgcctctttgtccttactataccgttcattggtgctttcccagcttaatgccgctgaggttgtttttatcatgacttctgtttggtagcctgcatctttgagtttttttaatgtttgtaacggcgtcgcggcattacgaaatgttccttcgacaacaatgttgagtttactgactatcgctctctcaattgcacgttcgaccgtttcgccggaaaatttcgctgtatgggtaacaaaatcatccccataattttggtagatataattaaaatcagggtgtagaaatcgaaaatcatcaccgttaataatcattatattatcttttgtctctcttttggctaattcaatcagagatgatttacctgctccgggttgcccacctaaaacaaaaccaatgggatgctgttgcggtgtgacttcatgatttgtcagacgctgccaaatagaatcaaaagatgctttattttctgaatgcgtagtattgttgaattcatgctgatattgagttcttacctgctgaaggagaatcttaccttgtgtaaaatcaacaagttcagcgggggtagaataaagataatcgcgatagctgactaatcgcttgagagcatcgcctgaatcctgatgcgacgaaactgagcaattatcaatgatatttgataaaaacgcgatgcactgactggctccgtttaaaagtgcatctttttccattaaagtagccattaacactcctgttaaatgatatttttcggtgattataatactgttctacaggagtgattttgcttttcagatattatttaatctatgttttcagtgaggatggcgtataacaatcggtgagcgttatacgccagtagggaaatattactcaaacaaattaaaatgcagcttctgcaccacctgctcggcatcttcgccgggcaccaggaagcacaggttatggctggatgcgccgtaacaaatcatgcgaatgttgaacggttccagtacgccgaatacctctttgccaacgccgcaggcttttgacaggtcattgccaatcaacgcgaccagcgccagaccttcttctacttccacccggcacagtgcggaaagctccatcagcagagattgcgtcagcaacgtatcgccagtggaggttgaaccggtggtatcaagggttaatgccacgctcacttctgacgtggtgattaagtctaccgaaatattatgccgcgcgaggatgccgaaaacttccgcgaggaagccgcgagaatgcagcatattcaggctgtgcaaagtgagcagagtctgattgcgacgaagcgccagcgcgcggaacagcggcggattttcagttttattgcacaccagcgtaccacctgcgcgtgggtctttgctggagccgacaaagaccgggatatcgctgcgtactgcgggtagcaacgttgccggatgcagtacttttgcaccaaaagttgccatctctgccgcttcggcaaacgcgatttcatcaatgcgttttgctgcggaaactacgcgtggatcggtggtgtagatgcccgggacgtcggtccagatatcaacacgagatgcgtgtaaagcctccgccagcaaggctgccgtataatcgctgcctccacggccaagcgtcgttgtacgacctttattttcgctaccgataaatccctgggtgatcactaagccgtcattgaggcgtgggagcagctgcagcgcggccagttccgccagcgcggctacatctggctctgcacgaccaaatcggtcgttggtacgcatcactttacgtacatcaaaccactgtgcctgaacatcgcgttcgcgcaggatttcgacaaacagcagggtcgacatcagctcgccgtggctgaccagctcatctgtcagcgccggagacgttgccagcgccgccgcttctgccagaacagtaatgttctccagcagacgttcaatctcttcacggataacgttcgggtaacgcagacgttccagaatggcaaactggatgttgcgaatagcgtcgagtttttcgaatcgctcgccaggttccagcccttccgctaaagcgaccagcagattagtgataccagcagaagccgagaggactactaaacgcacgttggcatcagaaagcacaatatcagcgctgcggttcatggcgtcaaaatcagctacgctggtaccgccaaatttggagacaacaatttcagacataactacctcgtgtcaggggatccattttcagccttggcacaagggaagagcggaagacgggtgggcgcagagcgatacttcgctactattttcacccagaagtgctccaccacttgcgaaacgcccgactgcgaacgcttctggtgacaacccaggggattcagcccctgtagccgatgatgaacgtggccagccgttcaatcacctcggcgatgcaccccctcaggtgttatcacaggactggctcctccaacaccgttacttgggcaacgcgcctcttctggcctgcgctagcgcaggtagtacatttataaataaagggtgagcggggcggttgtcaacgacggggtcatgcggatttttcatccactcctggcggtcagtagttcagctaataaatgcttcactgcgctaagggtttacactcaacattacgctaacggcactaaaaccatcacatttttctgtgactggcgctacaatcttccaaagtcacaattctcaaaatcagaagagtattgctaatgaaaaacatcaatccaacgcagaccgctgcctggcaggcactacagaaacacttcgatgaaatgaaagacgttacgatcgccgatctttttgctaaagacggcgatcgtttttctaagttctccgcaaccttcggcgatcagatgctggtggattactccaaaaaccgcatcactgaagagacgctggcgaaattacaagatctggcgaaagagtgcgatctggcgggcgcgattaagtcgatgttctctggcgagaagatcaaccgcactgaaaaccgcgctgtgctgcacgtagcgctgcgtaaccgtagcaataccccgattttggttgatggcaaagacgtaatgccggaagtcaacgcggtgctggagaagatgaaaaccttctcggaagcgattatctccggtgagtggaagggttataccggcaaagcaatcactgacgtagtgaacatcgggatcggcggttctgacctcggcccgtacatggtgaccgaagcactgcgtccgtacaaaaatcacctgaacatgcactttgtttctaacgtcgatgggactcacatcgcggaagtgctgaaaaaagtaaacccggaaaccacgctgttcctggtagcatctaaaaccttcaccactcaggaaaccatgaccaacgcccatagcgcgcgtgactggttcctgaaagcggcaggtgatgaaaaacacgttgcgaaacactttgcggcgctctcaaccaatgccaaagccgttggcgagtttggtattgatactgccaacatgttcgagttctgggactgggtcggcggccgttactctttgtggtcagcgattggcctgtcgattgttctctccatcggctttgataacttcgttgaactgctttctggcgcacacgcgatggacaagcatttctccaccacgcctgccgagaaaaacctgcctgtactgctggcgctgattggcatctggtacaacaatttctttggtgcggaaactgaggcgattctgccgtatgaccagtatatgcaccgtttcgcggcgtacttccagcagggcaatatggagtccaacggtaagtatgttgaccgtaacggtaacgttgtggattaccagactggcccgattatctggggtgaaccaggcactaacggtcagcacgcgttctaccagctgatccaccagggaaccaaaatggtaccgtgcgatttcatcgctccggctatcacccataacccgctctctgatcatcaccagaaactgctgtctaacttcttcgcccagaccgaagcgctggcgtttggtaaatcccgcgaagtggttgagcaggaatatcgtgatcagggtaaagatccggcaacgcttgactacgtggtgccgttcaaagtgttcgaaggtaaccgcccgaccaactccatcctgctgcgtgaaatcactccgttcagcctgggtgcgttgattgcgctgtatgagcacaaaatctttactcagggcgtgatcctgaacatcttcaccttcgaccagtggggcgtggagctgggtaaacaactggcaaaccgtattctgccagagctgaaagatgataaagaaatcagcagccacgatagctcgaccaatggtctgattaaccgctataaagcgtggcgcggttaatttaaaaaccttaataacaatgccgacgttatgtcggcattgttttatcagataaatccccttgtctgtgatttaacggaaatcataccgtgaggttaatcctaaaatagatttttaatcgtgattgatttcggaaaatactcagattaattacttttattttaacattatgatttttaatgttatttatatataagttgtagcttatatttgatattcattccaattatcctaaaaccccatctctaattccccgcgccgtaattcgcatgctttagttgtgtatactcgatcccgcccgaaatgtttttgggtaaatctccattcattcaatgaagggaaattgttatgaaaaaagttctgtatggcatttttgccatatctgcgcttgcggcgacttctgcgtgggctgcacctgtacaggtgggcgaagcggcagggtcggcagcaacgtcggtttcggcgggtagttcctccgcgaccagcgtcagcaccgtaagctcggcggtgggtgtcgcgctcgcggcaaccggtggcggtgatggttctaataccgggaccacaacaaccacgaccaccagtacccagtaataaagtatgtatccccaaaataattcgagtcatcgcatctgtggcttgaagtatgaagggatttaccataaccacactccggtgtggttattctgcccctctggagaagagtcgtgaagcgacctgcactcattcttatctgcctgctattacaggcctgttcagccacgactaaagagctgggcaattcactgtgggacagtctgttcggtacgccaggcgtacagctgacggatgatgatattcaaaatatgccctacgccagccagtatatgcagcttaatggcgggccgcagttgtttgtagtgctggcctttgccgaggatgggcaacaaaaatgggttactcaggatcaggccactctcgtcacacaacatggtcgtctggtgaagactttgcttggcggcgacaacctggttgaagtgaataaccttgccgccgacccgctgattaaaccagcacaaattgttgatggtgcaacatggacgcgcacgatgggctggaccgagtaccagcaggtacgctacgccaccgcacgctcagtcttcaaatgggatggcaccgataccgtcaaggtcggcagcgatgaaaccccggttcgcgtgctggacgaagaagtctccaccgaccaggcgcgctggcataaccgctattggatcgacagcgaagggcaaattcgccagtcggaacagtatctcggcgcggattatttcccggtgaaaaccactctcatcaaggcggcaaaacaatgattaaacaaacttttgtcgcgttgcttttgagtgtgggagcgtcatcggtcttcgcggcaggaaccgtcaaggtgttcagcaatggcagcagtgaggccaaaacactaacaggcgcagagcatttaatcgatctggtaggccaaccgcggctggcaaacagctggtggcccggtgcggtgatcagcgaagagctggcaacggcggcagcattgcgacagcagcaggcgttgctgacacggctggcagaactggccgcagactccagcgctgacgatgccgctgcgattaacgccttacgccagcaaattcaggcgttgaaagtgacgggtaggcaaaaaatcaatcttgatcccgatatcgtccgcgttgccgaacgcggtaacccaccgttgcagggcaactacacgctgtgggtcggaccaccgccgtccacggtcacgttgttcgggcttatcagccgtcctggcaagcagccattcactccaggtcgcgacgtggcgagctatctctctgaccagagcctgctcagcggtgcggatcgcagctacgcgtgggtggtttacccggacggacgcacgcaaaaagcgccggtggcttactggaacaagcgtcacgtagagccgatgcccggcagcattatttatgttggcctcgcggactccgtctggagtgagacgcctgatgcccttaacgccgacattcttcagactctgacgcagcggatacctcaataatgaaaaaaagacatctgcttagcttactggcgctgggcattagcacagcttgctacggcgaaacatatcctgcgcccattggtccgtcgcagtcggatttcggtggcgtaggattattacaaacgcccaccgcgcgtatggcacgggaaggggagttgagtctgaactatcgcgataacgatcagtaccgttattactcagcttcagtgcaactcttcccgtggctggaaacgacgctgcgttacaccgacgtgcgcacccggcagtacagcagcgtcgaagcgttctctggtgatcaaacgtataaagataaagccttcgatctcaaactgcgcttgtgggaagagagttactggctaccgcaagtggcggttggtgcgcgggatatcggcggtacggggctgtttgatgcggaatatcttgttgccagcaaagcctggggaccgttcgattttacgctcggcctgggctggggatatctgggtaccagcggtaatgtgaaaaatccgctctgttcagccagtgataaatattgctatcgcgataacagctacaagcaggcaggttcgatcgacggcagtcagatgttccacggcccggcatcactgtttggcggcgtggaataccagacgccctggcaaccgctgcgtctgaaactggagtatgaaggcaataattatcagcaggattttgccggtaagcttgagcaaaaaagtaagtttaacgtcggggcgatttatcgcgttaccgattgggccgacgttaaccttagctatgaacgtggcaactcctttatgtttggcgtcacgctgcgcaccaactttaacgatctgcgcccgtcttacaacgataacgcccgcccgcaatatcaaccgcagccgcaggatgccattttgcagcattcggtggtggcgaatcagttaacgctgttgaaatacaatgccggacttgccgatccgcagatccaggcgaaaggcgatacgctgtatgtcaccggcgagcaggtgaaatatcgtgattcgcgcgaagggatcatccgtgctaatcggatcgtgatgaacgatctgccggatgggatcaaaacgatccgcattacggaaaatcgtcttaacatgccgcaggtgacgacggaaaccgatgtcgccagcctgaaaaatcatctcgccggagagccgttgggccacgaaacgaagctggcgcaaaaacgcgtcgagccagtggttccgcagtccaccgagcagggctggtatatcgacaaatcacgctttgatttccacatcgatccggtgctgaaccagtcggtcggtggcccggaaaacttttacatgtatcagctgggcgtgatgggaacggcagatttgtggctgacggaccatctgctgaccaccggcagcctgtttgcaaatcttgccaacaactacgacaagtttaactacaccaatccgccgcaggactcgcacttaccgcgcgttcgtacccatgtgcgcgagtatgtgcagaacgatgtctatgtgaataacctgcaagccaactacttccagcatctgggcaacggcttctacggtcaggtctatggaggttatctcgaaaccatgtttggcggtgccggggcagaagtgttgtatcgtccgctggacagcaactgggcgtttggtctggatgccaactacgttaaacagcgcgactggcgtagtgcaaaagatatgatgaaattcaccgactacagcgtgaaaaccggacatctgaccgcctactggacgccatctttcgctcaggatgtgttagttaaagccagcgtcgggcagtatctggcaggggataaaggcggcacgctggagatcgccaaacgctttgatagcggcgtggtggtgggtggctatgccacgatcactaatgtttcaaaagaggagtacggcgaaggggacttcaccaaaggcgtgtatgtctcggtaccgttggatctcttctcgtctggcccgacacgcagccgtgcggcgattggctggacgccgctgacgcgtgacggtggtcagcaacttgggcgtaagttccagttgtatgatatgaccagcgaccgtagcgtaaatttccgctaagtcatgggaaaggtgccagttttcgcactcactggcaccctcattcttaatgacctgttgagccatcaggaacgcagttcacccccggtttgcgatctggtgtgtaaaggcgaaaacattctgtcttcctgtccgtcgatatcggttgcaggtctggttgcctgagcgactgggccatcattgggctggagacattgctttgcggtaggtcggctttatcagcagtaccgagcggaccagcataagcaggaagaacagagactgataacatcaaagcagcaaaataaggcttcatttttaccacctttatcaggttacgtttcatttgttccagaggaacatggtcgatttttcgcgcattgctggtggctgggaatcacctgaatgggtgattttttggggctgtgtgttttgccagatgcgacgttgatgggagatgcccacttaatcaagctgaacaaaacatacacaaaaaatatagatctccgtcacatttttgcgttatacaggaagctcgccactgtgaaggaggtactgctatgacgtcactctctcgtccgcgcgtggagtttatctccaccattttgcagaccgtactcaatcttggcctgttgtgcctcggcctgattttggttgtcttcctcggcaaagaaacggtgcatctggctgatgtgctgttcgcgccagaacaaaccagcaaatatgagctggtagaagggctggtggtttactttctctatttcgaatttatcgcgctgattgtgaagtactttcagtccggttttcacttcccgctacgttactttgtctatatcgggatcaccgccattgtgcgcttgatcattgtcgatcataaatcgccactggatgtgttgatctactcggctgcgatcctgttactggtgatcaccctgtggctgtgtaattcgaaacggctgaagcgggagtaaaaagacagcacgccgaactggcgcggcgtgctggacaggaagattacagcgtagcagtttgttgtgttttcttcgtttccggttcccagagggcttccagctcctcaagggttttacctttggtttccgggacaaatttccacataaacagtgctgccagaacgcccatacacccgtaaatccagtaggagaaaccgttgtggaaatgggccaccagccaggagtttttgtccatcatcgggaaggtccaggagacgaagtagttcgccagccactgggccgccaccgcgattgccagcgctttaccacgaatagcattcgggaagatttccgacagcagtacccagcataccggaccccaggacatggcaaaggcggcaacatagaacagcatcgacagtagcgccacaatacccgatgcctgagtgtaaaacgcggtaccgaggctaaacataccgattgccattccgagtgcgccgataatttgcagtggcttacgaccaaatttatccaccgtcataattgccagtacggtaaaggtgaggttgataactccgacaataatggtctgcaacagcgcgatatccgtgctggcccccagcgttttgaacacttccggcgcgtagtacaacaccacattgatgccgacaaattgctggaagatggagagcataacgccgattacaatcacgcccacgccaaacatcagcagacgaccaccggttttgcggccatgatccagggagtgtttaatttcctgtactgcctgagttgcaagcgtgttgcccataattttgcgcaggatactttccgcctgttcttgcttgccgcgtgacatcagccagcgaggactttctggcacggtatacagcagcattaagaacagcagtgcagggatacattccgaggcaaacatataacgccagccgtcagtattcagccagctggcatcaccggaacgggcaataaaatagtttacgcagtaaactaaaagttgcccgaaaataatcgcaaactggttaaatgaaaccagttttccgcgaatatgagctggagccagttccgcaatatacattggtgaaagcattgaggctaaaccaacgccaataccgccaataatacgataaataacaaattccgggacataacctgccagataaataggtactgtgttgtccgggtttatagaggtaaaaccaagttctggccaggcagaacctacaccagaaataaaaaacaggacagcagcaatcttaagtgaatcacgacggccgaagcggttactgcaataaccaccgagggcaccgccgatgatgcaaccaatcagagcgctggctacgcaaaatcctaacagggagttggcagcggattcacttaagttttgtggagcaacaaagacggtattgagtgactcaacagtaccggaaataacggcggtgtcgtagccaaataataaaccacctaatgtagcgactaaggtaatcgaaaatatataactggaattatactgggtattcattcagacctgccttagaccattctgatcttttatcagtgcattgatgttggaattgtcaggcagttaaggcaattatcattttttacaatgcgtttacgtaatgtcttttctgtgatcttaattgtgataattatcaaaaattgatgaaaacaatactattgccgtgactcagagcacgaaagagaattatcgtaagtgggaaaacaaataacgtaaaaataataagttctatgatgggaatattaaccggcgaacgattcagattgcagacgaaagaaaaaaaggcgctccgtggagcgccgaataacagtcacaagttgggataacgtaagttgagggtgcagcggcataacattggcagaacaacatctttaacctttcacaccacctgccgtcaggccgttgaccagccagcgttgagccagcaagaagacgatggtgatcggtaatgcagacatcacggcagcggcggcaaagtcaccccacaggtagttttgcgggttgaggtattgctgcatccccacggccagggtgtagctgtttacgtcacgcagtaacagcgacgcgaccggaacttcagtaatggcagcgataaacgacaagatgaataccaccgccagaatcggtactgacagcggcaacaggacaaggcggaaggcctgccacggtgtcgcaccatccagcgcagccgcttcttccagcgaactgtcgatggtttcgaaatagcctttgatggtccagacatgcagcgcaatcccacccagatacgcgaaaattacgccgccgtgagtattcaggccaatgaatggaatgtactcacccagacgatcaaacaacgcatacaacgcgaccagtgaaagtactgccgggaacatctggaaaatcagcattcctttcagcagcgtcgctttgcctggaaagcgcatacgggcgaaagcgtaggcgcaggtggtggagagcgccacaatgccaatcgcggaaatcccagcgacctttaccgagttccacagccacagcagtaccgggaatggcggtggcgtaatgcgaccatcagcctgttcaacgctaaaacctaacgccagtttccagtgatcccaggagatttgctccgggatcaggctaccggtcgcgaagtttccctgacgcagcgagatagcgacgaccatcagcagcgggaacataatcgccgcgataaaaagtagcagtagcaggtgagtaataaacaaacgtgctttttgcgatttcggttggaccattgccatttttgttatctcccttaatcaaacttcattcgcgtggctttcaggttcactatcgccagcgcacccaccagcaggaagatcagcgtggcaattgctgcagccagaccgaagtcctgacccccgccgccttcaaaagcgatacggtaggtgtagttaacaagcaggtcggtataaccggctggcgtggtcgtgccaagacgatccgggccgccgttggttaacagctgaatcagcacgaagttgttaaagttaaaggcgaagctggcgatcatcagcggcgtcagcggtttaatcagcagcggtagcgtaatcttaaagaagttctggaacggacctgcgccatccattgctgaggcttcatacaaatcgtccggaatcgctttcagcaagcccatgcagaggatcatcatgtacggataacccagccaagtattgacgataatcagcatcgtgcgggcggtggtcggatcgctgaaccaggcgggcttcacgccaaacagcgcgctcaacatcatgttgatttcaccgaagctctggttaaacaatcctttgaaaatcaagattgaaatgaacgatggcaccgcgtagggcagaatcagcaggacgcgatagaccgctttgccgcgcaacgcttcccactgcaccagacatgccagaaccatgccgaccgccaccgttaaaaagacagtgatcagcgagaacaccacggtccagacgaaaatggcgaggaacggtttctgaatgccttcgtcggtaaagacgcgggtaaagtttttccagccggtggtcacggtgtaaccggggcttagcttttcatcaccccagttgccgtcggcggtaatggactggtaaaagccaatttggttattcggacgatatttcacgccgctctgattattcgtcaacgtgccgtcaccgtcgagtgtgtagagcggctgcgtgccagaaaactggcgcagggagctcatcatcactttgttgccatccggcagaatggcggtaatgtcactcagcgcctgacgattctgggtaatcacgcgtagattcgcgcgttcgccttcgggctgggcggtcgtttctttcagttgcagtttttgctcgccgccaaatttaaaagcgtcggaaaggtaatttttgccggtttcgccgtcactgagcgccagttgccactcatcgcccgccgggtaaagaccaaagttataggttttgcctgcttgccaggagcgatctaacaacacttcctgcgcacgttcaaaagtcagctggttagtgctgctgtagttggtgaaggcaatggcgatggtgcagaccagagggaagaggacgaataatcccattccagccattcccgggtaaacatagcgccaggcgtaggctttacgattggcgaaaatatacagccccgctgaactcaatatcagcgtggtaatggcgaacaggtattccccttgtgcgtacattaaaacaacaaggtaacccaccagcaggccgagcagacctagcactgaccatttcagcgcgtcgctttgccaccaatgtttctttttaatgacatccatggggttcttcctcattccaggacggataaggctttcacgccttatccgacaacaactgcctgatgcgacactgatgcgtcttatcaggcctacatgcgtttcagttttgtaggccggacaaggcgttcacgccgcatccggcatttcacagcattacttggtgatacgagtctgcgcgtctttcagggcttcatcgacagtctgacgaccgctggcggcgttgatcaccgcagtacgcacggcataccagaaagcggacatctgcgggatgttcggcatgatttcacctttctgggcgttttccatggtggcggcaatacgtggatctttcgccaactcttcctcgtaagacttcagcgccactgcacccagcggtttgtctttattgaccgcttccagaccttcgtcagtcagcagatagttttcgaggaactctttcgccagctctttgttcggactggcggcgttaataccggcgctcagcacgccaacgaacggtttagatggttgacccttgaaggtcggcagtaccgttacaccataattcactttgctggtgtcgatgttggaccatgcccacgggccgttgatggtcatcgctgtttcgcctttattaaaggcagcttctgcgatggagtaatcggtgtctgcattcatgtgtttgtttttaataaggtcaaccaggaaggtcagacccgctttcgcgccagcgttatccacgcccacgtctttaatatcgtacttgccgttttcatacttgaacgcataacccccgtcagcagcaatcagcggccaggtgaagtacggttcttgcaggttgaacatcagcgcgctcttacctttcgctttcagttctttatccagcgccgggatctcttcccaggtttttggtgggttcggcagcagatctttgttataaatcagcgataacgcttcaacagcgatcgggtaagcaatcagcttgccgttgtaacgtacggcatcccaggtaaacggatacagcttgtcctggaacgctttgtccggggtgatttcagccaacaggccagattgagcgtagccaccaaagcggtcgtgtgcccagaagataatgtcagggccatcgccagttgccgcaacctgagggaatttctcttccagtttatccggatgctcaacggtgactttaattccggtatctttctcgaatttcttaccgacttcagcgagaccgttatagcctttatcgccgttaatccagattaccagtttaccttcttcgattttggcgagagccgaggcggaaaacatcatcgtcgttaatgcggataatgcgaggatgcgtgcacctgtttttattttcataatctatggtccttgttggtgaagtgctcgtgaaaacacctaaacggactctagtttctttatacggcaacctctttccatcctccttgcccctacgccccaccgttgctttgtgtgatctctgttacagaattggcggtaatgtggagatgcgcacataaaatcgccacgatttttgcaagcaacatcacgaaattccttacatgacctcggtttagttcacagaagccgtgttctcatcctcccgcctcctcccccataaaaaagccagggggtggaggatttaagccatctcctgatgacgcatagtcagcccatcatgaatgttgctgtcgatgacaggttgttacaaagggagaagggcatggcgagcgtacagctgcaaaatgtaacgaaagcctggggcgaggtcgtggtatcgaaagatatcaatctcgatatccatgaaggtgaattcgtggtgtttgtcggaccgtctggctgcggtaaatcgactttactgcgcatgattgccgggcttgagacgatcaccagcggcgacctgttcatcggtgagaaacggatgaatgacactccgccagcagaacgcggcgttggtatggtgtttcagtcttacgcgctctatccccacctgtcagtagcagaaaatatgtcatttggcctgaaactggcaggcgcaaaaaaagaggtgattaaccaacgcgttaaccaggtggcggaagtgctgcaactggcgcatttgctggatcgcaaaccgaaagcgctctctggcggtcagcgtcagcgtgtggcgattggccgtacgctggtggccgagccaagcgtatttttgctcgatgaaccgctctccaacctcgatgctgcactgcgtgtgcaaatgcgtatcgaaatctcccgtctgcataaacgcctgggccgcacaatgatttacgtcacccacgatcaggtcgaagcgatgacgctggccgacaaaatcgtggtgctggacgccggtcgcgtggcgcaggttgggaaaccgctggagctgtaccactatccggcagaccgttttgtcgccggatttatcggttcgccaaagatgaacttcctgccggtaaaagtgaccgccaccgcaatcgatcaagtgcaggtggagctgccgatgccaaatcgtcagcaagtctggctgccagttgaaagccgtgatgtccaggttggagccaatatgtcgctgggtattcgcccggaacatctactgccgagtgatatcgctgacgtcatccttgagggtgaagttcaggtcgtcgagcaactcggcaacgaaacccaaatccatatccagatcccttccattcgtcaaaacctggtgtaccgccagaacgacgtggtgttggtagaagaaggtgccacattcgctatcggcctgccgccagagcgttgccatctgttccgtgaggatggcactgcatgtcgtcgactgcataaggagccgggcgtttaagcaccccacaaaacacacaaagcctgtcacaggtgatgtgaaaaaagaaaagcaatgactcaggagatagaatgatgattactctgcgcaaacttcctctggcggttgccgtcgcagcgggcgtaatgtctgctcaggcaatggctgttgatttccacggctatgcacgttccggtattggctggacaggtagcggcggtgaacaacagtgtttccagactaccggtgctcaaagtaaataccgtcttggcaacgaatgtgaaacttatgctgaattaaaattgggtcaggaagtgtggaaagagggcgataagagcttctatttcgacactaacgtggcctattccgtcgcgcaacagaatgactgggaagctaccgatccggccttccgtgaagcaaacgtgcagggtaaaaacctgatcgaatggctgccaggttccaccatctgggcaggtaagcgcttctaccaacgtcatgacgttcatatgatcgacttctactactgggatatttctggtcctggtgccggtctggaaaacatcgatgttggcttcggtaaactctctctggcagcaacccgctcctctgaagctggtggttcttcctcttttgccagcaacaatatttatgactataccaacgaaaccgcgaacgacgttttcgatgtgcgtttagcgcagatggaaatcaacccgggcggcacattagaactgggtgtcgactacggtcgtgccaacctgcgtgataactatcgtctggttgatggcgcatcgaaagacggctggttattcactgctgaacatactcagagtgtcctgaagggctttaacaagtttgttgttcagtacgctactgactcgatgacctcgcagggtaaaggtctgtcgcagggttctggcgtcgcgtttgataacgaaaaatttgcctacaatatcaacaacaacggtcacatgctgcgtatcctcgaccacggtgcgatctccatgggcgacaactgggacatgatgtacgtgggtatgtaccaggatatcaactgggataacgacaacggcaccaagtggtggaccgttggtattcgcccgatgtacaagtggacgccaatcatgagcaccgtgatggaaatcggctacgacaacgtcgaatcccagcgcaccggcgacaagaacaatcagtacaaaattaccctcgcacaacaatggcaggctggcgacagcatctggtcacgcccggctattcgtgtcttcgcaacctacgccaagtgggatgagaaatggggttatgactacaacggcgatagcaaggttaacccgaactacggcaaagccgttcctgctgatttcaacggcggcagcttcggtcgtggcgacagcgacgagtggaccttcggtgcccagatggaaatctggtggtaatagcaaaacctgggccggataaggtgcttgcgccgcatccggcaaccaacgcctgatgcgacgcttgcgcgtcttatcaggcctacaacggctgtcaaatgtaggccggataaggcgtttacgccgtatccggcataaaaacaggttgtcattatctgaaaggggcgcaagcccctctgattatcgggtttagcgcgctattgcctggctaccgctgagctccagattttgaggtgaaaacaatgaaaatgaataaaagtctcatcgccctctgtttatcagcagggttactggcaagcgcgcctggaatcagccttgccgatgttaactacgtaccgcaaaacaccagcgacgcgccagccattccatctgccgcgctgcaacaactcacctggacaccggtcgatcaatctaaaacccagaccacccaactggcgaccggcggccaacaactgaacgttcccggcatcagtggtccggttgctgcgtacagcgtcccggcaaacattggcgaactgaccctgacgctgaccagcgaagtgaacaaacaaaccagcgtttttgcgccgaacgtgctgattcttgatcagaacatgaccccatcagccttcttccccagcagttatttcacctaccaggaaccaggcgtgatgagtgcagatcggctggaaggcgttatgcgcctgacaccggcgttggggcagcaaaaactttatgttctggtctttaccacggaaaaagatctccagcagacgacccaactgctcgacccggctaaagcctatgccaagggcgtcggtaactcgatcccggatatccccgatccggttgctcgtcataccaccgatggcttactgaaactgaaagtgaaaacgaactccagctccagcgtgttggtaggacctttatttggttcttccgctccagctccggttacggtaggtaacacggcggcaccagctgtggctgcacccgctccggcaccggtgaagaaaagcgagccgatgctcaacgacacggaaagttattttaataccgcgatcaaaaacgctgtcgcgaaaggtgatgttgataaggcgttaaaactgcttgatgaagctgaacgcctgggatcgacatctgcccgttccacctttatcagcagtgtaaaaggcaaggggtaattacgccccacagtgctgattttgcaacaactggtgcgtctcctggcgcacctttttttatgcttccttcctgggatatgagcgattttttatagtaactcacttcttcttcactaagaatatccattatctcaatgccttatcagagattcttttcctttcgccggtagtgtctggacattcaggctacttttccaggttattttatttctgttatgcagaggttttatgataagtcatatcctaaattctggcggcaataactctttgatgaaacatgatgtggtgcaaggaaataatatagtagatcttgatttactacgtaatttcaatggggtgccaggtttaaacagagataactttatttatatcagcaatattttttcaaatataaaacaacggaacgaaaaaatcatgcaataaatatgtttcgtgaagtctcaatcagtaatgatactataagtgtaaaattctacagaaatgaaaaaaattgaatgcgcttgcaattttctgatggataaagatgcgcaggggtatatcgacctgtctgatttggatttaacaagttgtcattttaaaggtgacgttatatcgaaggtgtcttttttatcatcaaatctacaacatgtaacattcgaatgtaaagaaattggggattgcaattttactactgcaatagttgataatgtcatatttagatgtcgacgtttacacaatgtgatttttatcaaagcgagtggtgaatgtgtcgatttcagcaaaaatattcttgatacagttgacttctcgcagagtcaacttactcagagtaattttcgcgaatatcagattagaaattcaaacttcgataattgttatctttacgcttcgcacttcaccagagcagagtttctgtctgccaaagaaatatcatttattaaatcgaatatgacagctgttatgtttgatcatgtgcgaatatcgacagggaattttaaagattgcattacagaacaattggaattaactattgattattcagatatatttgggaatgaagatctcgatggttatatcaataacattataaaaatgattgatacattgccagataatgcaatgatattgaaatccgttctggcagtaaaactggttatgcaattaaaaattcttaatattgttaataaaaactttattgagaatatgaagaaaacatttagccattgtccttatataaaagatccaattatacgcagttatatccattctggtgaagataacaagttcgatgattttatgcgtcaacatcgattcagcaaggtggatttcgatacccaacagatgatccattttattaacaggtttaatatgaataaagggctgattgataaaaataacaatttttttatccaacttatcgatcaggccttacgatcaacggatgatatgatcaaagcaaatgcctggtatctttataaagagtggattcgtagtgatgatgtttcacctctatttatagaaattgaagataatttaagaacctttaacacgaatgaattaacacgaaaggataatatctttatcctgttctcctctgccgatgatgggccagttatggtggtaagctcccagcgcttacatgatatgttgaatcctacaaaagataccaattggaattccacgtgtatctataaatccagacataagatgttgcctattaatcttactcaggaaacactttttagctccaaatctcatggtaaatatgcgcttttcccaatttttactgcgagttggcgagctactcgtataaagaatataggtatttaagtaaaggaaaacatcaccgttcctggcatcatgggcggtgatgcccctacggttgccctcgccagcacgggcatcggcaaagcgtaaggttcaacagcggtttaccacttcatgcgattgttgcgtttttgttgcgcattagatcacttaatttgctttacatctcccgtaaacacttttctgcgatacaatgcctttacgttatgtaacggagagttcggcatgtcacaccccgcgttaacgcaactgcgtgcgctgcgctattttaaagagatccctgccctggatccgcaactgctcgactggctgttgctggaggattccatgacaaaacgttttgaacagcagggaaaaacggtaagcgtgacgatgatccgcgaagggtttgtcgagcagaatgaaatccccgaagaactgccgctgctgccgaaagagtctcgttactggttacgtgaaattttgttatgtgccgatggtgaaccgtggcttgccggtcgtaccgtcgttcctgtgtcaacgttaagcgggccggagctggcgttacaaaaattgggtaaaacgccgttaggacgctatctgttcacatcatcgacattaacccgggactttattgagataggccgtgatgccggactgtgggggcgacgttcccgcctgcgattaagcggtaaaccgctgttgctaacagaactgtttttaccggcgtcaccgttgtactaagaggaaaaaaatatggagtggagtctgacgcagaataagctgctggcgtttcatcgcttaatgcgtacggataagccaattggcgcgttactgctgctctggccaacattatgggcgttgtgggtggcgacaccgggcgttcctcagctctggatcctggcggtatttgtcgcgggtgtctggctgatgcgcgctgctggatgtgtggtgaatgattatgctgaccgaaagtttgatggtcatgttaagcgcacggcgaaccgaccacttcccagcggcgcggtaacagagaaagaggcgcgcgcactgtttgtagtgctggtactgatttcgtttttactggtactgacgctgaatacgatgaccattctgttgtcgattgccgctctggcgttggcgtgggtgtacccgtttatgaagcggtatacccatctcccgcaagtggtgctgggcgcggcgtttggctggtcgattccaatggcttttgccgctgtgagtgagtcggtgccattgagttgctggttaatgttcctcgccaatattctctgggcggtggcttacgacacgcagtatgcgatggttgaccgcgatgatgatgtgaagattggcattaaatccacggcaatcctgttcggccaatacgataaattgattattggtattttgcagattggcgtactggcactgatggcgatcatcggtgagttaaatggcttaggctggggatattactggtcaattgtggtggctggcgcgctgtttgtttatcaacaaaaactgattgccaaccgcgagcgtgaagcctgctttaaagcatttatgaataataactatgttggtctggtactatttttagggctggcaatgagttactggcatttctgatgatgtaaaaaagccggatgatcatccggctttcttctgggttgcctgatgcgcggcgcttctcaggcctacacaacacatcgcaatttattgaatttgcagattatggaaggccggataaggcgttttcgccgcatccggcaattctctctgattacccttcgccctgcgtcgcactctcaatcgtcaaacgcacgtctgatgtaatcaactccgccagcaactgataaaccttcatcgtttctgccggttcggcgtcgccgctatcgctgatatacccttcatcacgcagcgtcagcaccagagaactgaacaccgccttgtcgaagaactccggcgcgttgatgccgtgcagcacggagagacgttgcgcgacggtgcggctctctttctccagcgtaccgcggttgatcgacgggttggcactcaacaaccagaaggtgatggcataacgttgcagcgtttcgcgcgcgcctgcggccagcagctgtagggtgcgagaatgcgccgggttgatatgcaactcatcatcttgcagggtaatcagcccctgacgttgcatctcatttgccagcgcatcaataacgtccggcaactcgtcgcgatcccagcgcaggaacagctccgctttcagcattgggtaaagcacattgacgtgctccatcaatacgtcgcgggagatgtggcgatgctgggtgacaattgccgccatcagcgaaggcagcaccaacatatgcgcaatgttgttgcgatagtaggtcatcagcaccgcttgctcgcgtggcagaatgatgatgtcgccgatagtgtctttctcgacttcaaacttgttcatttgcagcgcgtgatcgataagctcgctggcgctggctgaaggaacggtagagtccgtggagtaaggtacgttgcgcatcagatccaggtagcagttgagttgctcggttaactgctcgcgggtgagtgagcgctgacgtgatgccagtagcgcagtacagcacaggttcatggcgtttgccgcgcctgcgttgttaatgcgtaccatcagatcggcagcaatattattgaccgtcggcgttaaccaggccggacgcaccgcttcgatgggatcgatagattcacgccagtctggtacgtgctggttaaggtaggtcatcaacggcattggttcaccgaagttgacgtaaccctgaccgagattacgcagcttgcttaaaccgcgcagcatctgcggcaggctctctttctctttcgtcgcgccgcgcagttctttggcgtaagtacccacttccatgacgtgctcataaccgatatagatcggaatcagcgtaatcggacgcgtgccgccacgcagcatcgcctgaatggtcatcgacagcgtaccggttttcggatccagcaaacgccccgtgcgggaacgaccgccttccacgaagtactcgacggaataaccacggctgaacagttcgccgagatactcacggaaaacggtggaataaagtttattgcctttaaaagtacggcgaataaagaacgcccccagacggcggaaaatcggcccggccggccagaagttcaggttgatcccggcggcgatatgcggcggcaccagcccctggtggtacagcacgtaagaaagtagcaggtagtccatgtgactgcggtggcaaggcacatacaccagctcatgaccgtcgtgggccagctggcgaacgcgctcggcgttatggacgttgatgccctgataaagtcggttccaggtgaagcccagaatgcggtcagtcaggcggatcatctcgtaagagaaattcgccgcaatctcttccatcagcgcaatcgcgttctgctgcgctttttcatgggagatttttttgctgcgcgcttcatcttctaccgctttggcaatggcgcgggaggcgagcagcttattaaacagatcctgacgagcaggcagacgtgggcccacagcagccagacgttgacgggcaaagtgcatacgcgccacgcgcgccagtttctgtgcgatagttttatccgtgccgtgttcatccgccatacggcgcagcgaaactgacggcgagaaacgcacaaaactgtcgcgaccgagccacagtacggcgaaaaatttctgtacgccgttaagcatacgcagcggcgggtttacttcgcctttttcacgccccggcgcgcgaccaaacatcaccgatactggcaccatctgcacatccagatttgggttgctacggtgcaaatcgagatagtcgtggaacagcttaatagactcttctttcggcgtgtaataggtgaatacacgcggcccgccgtgaatgaacacatagcgcggcagtagcgtgccgtcgatttccagcggctctaacgggtcaggcaagtcatgagccagacactgggcgcgtaacgtcagcaaatctgctttcgagttgtacggtaaaacgtacataattggacgagaagtatccagccccagttccggggcaggatctgccggaatagacttgctttttaccaggatgcttaatggtaaattcagtaatttgtagtaaattcgtggccagccggacataaacgatgtaaagcctctggttaataatgcaaatgcgcggcaaggatagcagaaagtcatgggaaattctgtggtatccgctcatgtttcgcgcggcgttacgcaaacccgaatcatcggatttaacggtacactgatattgacgctcataatgtaaaaaggttctttcaatggccaataataccactggattcacccgaattatcaaagctgctggctattcctggaaaggtttacgcgctgcatggatcaacgaagcggcattccgtcaggaaggcgtagcggtattgttggcggtggtcatcgcctgctggctggatgtggacgcaattacccgcgtgctgcttatcagctccgtgatgctggtgatgattgtggaaattctcaatagcgccatcgaagcagtggttgaccgaattggctctgaataccatgagctttccggacgcgctaaagatatgggatccgccgcggtgctgattgccattatcgtcgccgtgattacctggtgcattctgttatggtcgcattttggataacccttccagatttcgataaatctctggtttattgtgcagtttatggttccaaaatcgccttttgctgtatatactcacagcataactgtatatacacccagggggcggaatgaaagcgttaacggccaggcaacaagaggtgtttgatctcatccgtgatcacatcagccagacaggtatgccgccgacgcgtgcggaaatcgcgcagcgtttggggttccgttccccaaacgcggctgaagaacatctgaaggcgctggcacgcaaaggcgttattgaaattgtttccggcgcatcacgcgggattcgtctgttgcaggaagaggaagaagggttgccgctggtaggtcgtgtggctgccggtgaaccgcttctggcgcaacagcatattgaaggtcattatcaggtcgatccttccttgttcaagccgaatgctgatttcctgctgcgcgtcagcgggatgtcgatgaaagatatcggcattatggatggtgacttgctggcagtgcataaaactcaggatgtacgtaacggtcaggtcgttgtcgcacgtattgatgacgaagttaccgttaagcgcctgaaaaaacagggcaataaagtcgaactgttgccagaaaatagcgagtttaaaccaattgtcgttgaccttcgtcagcagagcttcaccattgaagggctggcggttggggttattcgcaacggcgactggctgtaacatatctctgagaccgcgatgccgccaggcgtcgcggtttgtttttcatctctcttcatcaggcttgtctgcatggcattcctcacttcatctgataaagcactctggcatctcgccttacccatgattttctccaatatcaccgttccgttgctgggactggtcgatacggcggtaattggtcatcttgatagcccggtttatttgggcggcgtggcggttggtgcaacggcgaccagctttctctttatgctgttgctgtttttacgcatgagcaccaccgggctgactgcgcaggcttatggtgccaaaaatcctcaggcattagcccgtgcgctggtgcaaccgttgctgttggcgttgggggctggggcgttaattgcgctgctgcgtacaccgattatcgatctggcgctgcatattgttggcggtagtgaagcggtcctggaacaggcgcggcgctttcttgaaatccgctggttaagcgctccggcgtcgctggcgaatctggtattactcggttggttactcggcgtgcaatatgcccgtgcgccagtaattttgttagtggtcggcaatatcctcaacattgtgctggatgtctggctggtgatggggctgcatatgaacgtgcagggcgcggcgctggcgacggttattgcggaatatgcaacattgctgattggtctgctaatggtgcgtaaaatcctcaaactacgcggaatttccggcgaaatgctgaaaactgcctggcgaggaaacttccgtcgcttgctggcgcttaaccgcgatatcatgctgcgttcgctgttgttgcaactctgtttcggcgcgatcaccgtacttggtgcgcgactggggagtgacattgtcgctgttaacgcggttctgatgacgctactcacctttaccgcctatgcgcttgatggttttgcctacgcggttgaagcgcactccggtcaggcatacggtgcgcgcgacggtagccagttgctggatgtatggcgggcagcgtgccgccagtcggggattgtagcgttactgttttcggtggtttatttgctggcaggggaacacatcattgcgttgctgacgtcgttaacccagattcagcagctggctgaccgctatcttatctggcaggtgattttgccgttggttggcgtctggtgttatctgctggacggcatgtttataggcgcaacgcgtgccgccgaaatgcgtaacagtatggcggtggccgccgcaggttttgcgctgacgctccttacgctgccgtggctgggtaatcatggtttgtggctggcattaaccgtctttctggcgttgcgcgggctttctctggcggctatctggcggcgtcactggcgcaacggtacctggtttgccgcaacgtgacggttaaaaattctgaataaattatcctaagccaaattgctgactacacttaatctcacgttcagaagaaaagtgaacgtactctcattcacaacctaacgatgaggtcttgattatgaataaagatgaagccggcggtaactggaaacagtttaaaggtaaagtgaaagagcaatggggcaaactgaccgatgatgatatgacgatcattgaaggtaaacgtgatcaactggtcggtaaaatccaggaacgttatggttatcagaaagatcaggcagaaaaagaggtcgtggattgggaaacccgcaatgaatatcgctggtaattaatccctcctgcccgacgtgtacaaggatgtacgccctcttaacgcggtttctttttcacctgcacagagtgatcatgctggcactgttcaggatgacgacacgcttccacttccacgcatgccgcacagagcccatgtgcttcaatcacattatgccgcagggcaaaccccatttttgccgccagcgtatgcataatgtcttccacgccttctgcacactcttctttcaccgcgccgcagcgatcgcatataaacatggctgacgtatgcgtgggctggtcgaacagatgacagagcacataactgttggtggattccaccttatgcacaaaaccttgctcaagcagaaaatccagcgcgcgataaaccgttggcggcttggcttgcggttcagcttcgcgcagtaaatcaagcagatcataagcgctgatagcgccatcctgcagactcatcaggcgcaacacttccaggcgctgtggggtcaggcgcacattacgctgcgcgcagattttttcagcctgcgctaataactcctgcgttgtggtcttttccatcgggcacctcaaagtgggggttaagaatgtccttactttaccatgttccaggaaaaacaccgagaacccttattgttgccgtaatgttgattttctgttttgtaggtaaggtgttgtgttgccttgtcgtaccattatcaacacgataataattaataattcatttttaaataaattgcttcaagttaactcgctatttatttaactgggtttaaacgcatacctgtagttcagaaattatgagcgatttttgatagtgaccagatggcaaaagaattataaggaggacacggtacgacaaaaaaggtagatgaatcatgttgaagataatacccggtgcaactggatactttaataaaacactcaattcaaatcaattcgataatgaagatgcaatcaaagataaattagataatagaggttcaatcaaaggtaaattaaataatatatatggtaaatctattgattatgcagcgctgcgtcatcgggatataattattacaaaaatagatttgtttattcaacgaatcacgcataatttatggcatgcacgtaaaaaaatgtgtttttaattgagcaaataaatgatctcaaaatgtgggtcaataagtatattgacgattgcactgatgaggatttaaacgatcgtgactttattgcatcagttgttgaccgggctatttttcatttcgcgattaatagtatatgtaatcctggggataataaagatgcgactcccattgaacaatgtacttttgatgtagaaactaagaatggccttccctccacggttcagctattttatgaggaatctaaggataatgaacctttagcgaatatacattttcaagcaataggttctggttttttaacgtttgttaatgcctgccaggaacatgatgacaacagcttaaaattatttgcttcgctgttaatttcactttcatattctagtgcctacgcagatttatcagaaacagtgtatattaatgaaaataatgagagctacctgaaagctcagtttgaaaaattatctcaacgtgatatgaagaagtacctgggagagatgaagcgtctggctgatgggggagaaatgaattttgatggctatctggataagatgtcacatctggtgaatgaaggaacgctcgatcctgatattttaagcaaaatgcgagatgctgcaccacaattaattagcttcgcgaagtcgtttgacccaacctcaaaggaagagattaaaatacttacagacacttctaaattaatttatgatttgttcggggttaaatcggagaaataatatgtgaagttcttcgatagtatggaaggcattatataaaaggacccaatatttattgggttcttttttctctatcaatgctattagcagggagatatatcaccagagtttaatgtgtgattttttatttatcgtcgaacctggattgtttatcattggccttaacaaagttaacggctaataagattatttccatcacttcgtgagagcttcatgccttgagaggatctcaattttcttttgcaatgagacaggcgcttcctgttgttatggtatagtaccccgctattgagcctcctgaacagtgaagctgaataacataaccccatgatatattgataaaataatctctacatttgaaaatgcacggtaattctgaaatgcaaaaaatcaaccaaaccagcgcaatgcctgaaaaaactgacgttcactggagtggtcggtttagcgttgcaccaatgctcgactggacggacagacattgccgctatttcttgcgtctgctttcccgcaatacgttgctttataccgaaatggtgaccacaggggcgattattcacggtaaaggtgattatctggcgtacagtgaagaagaacatccggtagcgttgcaactgggcggtagcgatccggcggcgctggcgcagtgtgcaaagctggcagaagcgcgcggatatgatgagatcaacctgaatgtcggctgcccgtctgaccgggtgcagaacggcatgtttggtgcgtgtctgatgggtaatgcgcagctggttgccgactgcgtgaaagcgatgcgcgatgtggtgtcgattccggtgacggtgaaaacgcgtattggcatcgacgaccaggacagctatgaatttctctgcgatttcatcaataccgtttccggcaaaggcgagtgtgagatgttcatcatccacgcacgtaaagcctggctttcggggttaagcccgaaagaaaaccgtgaaatcccgccgctcgattatccgcgtgtgtatcaactgaagcgtgactttccgcatctgacaatgtcgattaacggtggtatcaagtcgctggaagaggccaaagcacacctgcaacatatggatggcgtgatggtcgggcgcgaggcgtatcagaatccgggtattctggcggcggtagaccgggagatctttggttcctcggataccgatgccgatccggtggcggtagtgcgcgccatgtatccgtacattgagcgtgaactcagccaggggacgtatctcggccatattacccggcatatgctgggtttgttccagggtattcctggcgcgcggcagtggcggcgttatttaagtgaaaatgcccataaagcgggtgctgacattaacgtgctggaacacgcgctcaaactggtggcggataagcgttaacttttcaccaaaaagtagtcaaattcaccacgccctgcgcaccgtcgcggggcgttttgctgttaaatcaatagattatttttggcatgattcttgtaatgccagcaagagatttcatatttgggagagcatcatgctggaactactttttgtgattggcttttttgtcatgctgatggtcaccggcgtttcgttgctgggcattatcgccgcgctggttgtggcgacggccattatgttcctcggcggtatgctggcattgatgattaagttgctgccgtggttactactggcgattgcggtggtgtgggttattaaggcgattaaagcaccaaaaatgccgaaatatcagcgttatgaccgctggcgttactaagggattgtgcggatgatcacaacctaaggttttatccttagaacaaaataggaattgataatcaaatctgtcactattgcgcctctaacagattcatcgtgctgtaccctacatacagccgaactataaaaagaaagggcttcccaggtggaagccctatttcttttatggaatcagcaggctggaaccttgcgtcgcccggctttccagaatctcatgcgcacgctgcgcatccttcagcggatatttctgctgctcggcgacatcgaccttaatcacaccgctggcaatcaaagagaacagttcattactggcctcggttaattcctcccgcgtggtgatatagccttgcagggaagggcgtgtcacatacaacgagcctttttgattgagaatgcctaagttcacaccggtaaccgcacctgatgagttgccaaaactgaccattaagccgcggcgttgcaggcaatccagcgaccgttcccaggtgtctctgcccacggaatcgtacactacgcgcactttcttaccgccggtgatctctttcaatcgctcgaccagattctcttcacgatagttaataacctgccacgcgccggcttttagcgcgctctgcgctttttgcgcggttcctacggtgccgataagtttcgcgcccagggcttttgcccactggcaggcaattaagccaacgccgccagccgctgcgtggaacaggaactgttcatcgggtttaatttcataggttttgcgcagcagataataaaccgttaagcctttcaggaaagatgctgcagcttgttcaaaagaaattgccgcaggcagaatcgccgctttatccgcattaatgttatgcacagagctgtaagcgcctaacgccgactgcgcatagacaacacgatcgcctgccttaatatgctttacaccactgccgactttactcacgatgcctgccgcttcggtacctaatccgctgggtagtgatggcggcgggtaaaggccgctgcggatatacgtgtcgataaaattgatgccgatggctttattttcgacctggatttcattctctgccggatcggcaggagtgaactctacggcttgaagtacttccgggccaccgtgcttgtgaaattcaattcgtgttgccatgtgtcctccagaacgtatcgtcagggtctgcttcatatggtaaagtttcgacccattctttatctcggtaactccattcactatggcaggaaataaacccttcaacaaacagcaggctgaaccccgcgaacgcgatccacaagttgccgggctgaaagtgcctccgcactcgatcgaagcggagcagtcggtgttgggcggtttaatgctggataacgaacgctgggacgatgtagccgagcgtgtggtggcagacgatttttacacccgcccacaccgccatatctttactgaaatggcgcgtttgcaggaaagcggtagtcctatcgatctgattacccttgcggaatcgctggaacgccaggggcaactcgatagcgtcggtggttttgcttatctggcagagctgtcaaaaaatacgccaagtgcggcgaacatcagtgcctatgcggacatcgtgcgtgaacgtgccgttgtccgtgagatgatttcggttgcgaatgagattgctgaagccggttttgatccgcaggggcgcaccagcgaagatctgctggaccttgctgaatcccgcgtctttaaaattgctgaaagtcgtgcaaacaaagacgaagggccgaagaacatcgccgatgtgctcgacgcaaccgtggcgcgtattgagcagttgtttcagcagccacacgatggcgttaccggagtaaacaccggttatgacgatctcaacaaaaaaaccgctggcttgcagccgtcggatttgatcatcatcgccgcgcgtccgtcgatgggtaaaacaacatttgcgatgaacctcgtcgaaaacgcggcgatgttgcaggataaaccagtacttatcttctcgctggagatgccttcagaacagattatgatgcgttctctggcgtcgctgtcgcgcgttgaccagactaaaatccgtaccgggcagctcgatgatgaagactgggcgcgcatttccggcaccatgggtattttgctcgaaaaacgcaatatctatatcgatgactcctccggcctgacgccaacggaagtgcgttcccgcgcacgccgtattgcccgtgaacacggcggcatcgggcttatcatgatcgactacctgcaactgatgcgcgtaccggcgctttccgataaccgtacgctggaaattgcagaaatctctcgctcgctgaaagcactggcgaaagaactgaacgtgccggtggtggcgctgtcccagttgaaccgttctctggaacaacgtgccgacaaacgcccggtcaactccgacctgcgtgaatctggctctatcgagcaggatgcggacttgatcatgtttatctatcgtgatgaggtgtatcacgaaaacagtgatttaaaaggcatcgcggaaattattatcggtaaacaacgtaacggcccaatcgggacggtacgcctgacctttaacggtcaatggtcgcgcttcgacaactatgcggggccgcagtacgacgacgaataataattattttatgaattaggtaattaaagcaaacacttatcaaggaacacaaatgcaagcggcaactgttgtgattaaccgccgcgctctgcgacacaacctgcaacgtcttcgtgaactggcacctgccagtaaaatggttgcggtggtgaaagcgaacgcttatggtcacggtcttcttgagaccgcgcgaacgctccccgatgctgacgcctttggcgtagcccgtctcgaagaagctctgcgactgcgtgcggggggaatcaccaaacctgtactgttactcgaaggcttttttgatgccagagatctgccgacgatttctgcgcaacattttcataccgccgtgcataacgaagaacagctggctgcgctggaagaggctagcctggacgagccggttaccgtctggatgaaactcgataccggtatgcaccgtctgggcgtaaggccggaacaggctgaggcgttttatcatcgcctgacccagtgcaaaaacgttcgtcagccggtgaatatcgtcagccattttgcgcgcgcggatgaaccaaaatgtggcgcaaccgagaaacaactcgctatctttaataccttttgcgaaggcaaacctggtcaacgttccattgccgcatcgggtggcattctgctgtggccacagtcgcattttgactgggtgcgcccgggcatcattctttatggcgtctcgccgctggaagatcgctccaccggtgccgattttggctgtcagccagtgatgtcactaacctccagcctgattgccgtgcgtgagcataaagccggagaacctgttggttatggtggaacctgggtaagcgaacgtgatacccgtcttggcgtagtcgcgatgggctatggcgatggttatccgcgcgccgcgccgtccggtacgccagtgctggtgaacggtcgcgaagtaccgattgtcgggcgcgtggcgatggatatgatctgcgtagacttaggtccacaggcgcaggacaaagccggggatccggtcattttatggggcgaaggtttgcccgtagaacgtatcgctgaaatgacgaaagtaagcgcttacgaacttattacgcgcctgacttcaagggtcgcgatgaaatacgtggattaatcgttctgtaatatttgattgtctgtgccggatgcggcgtgaatgccttatccggccaataaaatcctaaaaattcaataagttgatgttctttcatgctcttataaaggtcgtgcctctggcggatgtacgtttgtcatgagtctcactctgttgctaattgccgttcgctcctgaacatccactcgatcttcgccttcttccggtttattgtgttttaaccacctgcccgtaaacctggagaaccatcgcgtgtttcaaaaagttgacgcctacgctggcgacccgattcttacgcttatggagcgttttaaagaagaccctcgcagcgacaaagtgaatttaagtatcggtctgtactacaacgaagacggaattattccacaactgaaagccgtggcggaggcggaagcgcgcctgaatgcgcagcctcatggcgcttcgctttatttaccgatggaagggcttaacagctatcgccatgccattgcgccgctgctgtttggtgcggaccatccggtactgaaacaacagcgcgtagcaaccattcaaacccttggcggctccggggcattgaaagtgggcgcggatttcctgaaacgctacttcccggaatcaggcgtctgggtcagcgatcctacctgggaaaaccacatagcaatattcgccggggctggattcgaagtgagtacttacccctggtatgacgaagcgactaacggcgtgcgctttaatgacctgttggcgacgctgaaaacattacctgcccgcagtattgtgttgctgcatccatgttgccacaacccaacgggtgccgatctcactaatgaccagtgggatgcggtgattgaaattctcaaagcccgcgagcttattccattcctcgatattgcctatcaaggatttggtgccggtatggaagaggatgcctacgctattcgcgccattgccagcgctggattacccgctctggtgagcaattcgttctcgaaaattttctccctttacggcgagcgcgtcggcggactttctgttatgtgtgaagatgccgaagccgctggccgcgtactggggcaattgaaagcaacagttcgccgcaactactccagcccgccgaattttggtgcgcaggtggtggctgcagtgctgaatgacgaggcattgaaagccagctggctggcggaagtagaagagatgcgtactcgcattctggcaatgcgtcaggaactggtgaaggtattaagcacagagatgccagaacgcaatttcgattatctgcttaatcagcgcggcatgttcagttataccggtttaagtgccgctcaggttgaccgactacgtgaagaatttggtgtctatctcatcgccagcggtcgcatgtgtgtcgccgggttaaatacggcaaatgtacaacgtgtggcaaaggcgtttgctgcggtgatgtaatgcaggaaagcaggctggagctacccagcctgcagtgaaattaaactgtcgtcgctttcactctttctttatagatgatttttttgatgccatcgttctacgtgagagataataaacgttattagttcttttattgttaagcttatcctaattatctggaattccttatcctgtttttttgggtggggtaataatttctgcacatctaactattattaaatttaataataagtatcgggtttgttacgatagaatttttctatatcctcaagaatatgctttgccttattgcctgtgactttctgagattcaattatagtatcgttaaattctaaagttaaagagagctctttttttccgctttgtgtaagtttaaccttatattgattgccaatatcaaataaaaaggtcctgtaatgagaataatcacctttaacctcctcggcaaaacagcaaagcgtgcaaatatacataaagtctttcttacccctgattttgttaactaaatcaataaatgcgtgaaaaactttacttgcaatagaacttgatacttcttctccaggtctacaaaaatcttttgcaatttttaactgtgtttctatgtataaaaagaaatctttagcataagaaaaatctttggcataagagatatctttattatttagtgcatctagctcaacaggtaaagatgtcgttttgttgctattcacatatgatatattcatatcatcatctccatcgggagtaataaaattagtcaccattgtaggatagggttctggtcaatcaggaatcatctttataaacttcgattgtttttgtaatgctgtatcattaagttcattaaatcgtacagcagataaatgttctatcaaatttcgctcatttgcagaggattcatcataataaacgtaaaattaatgtatccttacatcgagtaataaacattttttatacaaaaaaagacaggaacgtatttactgggttaaacataatcatcctgcttttcatcacaaaaaccgcagataatccttcctttccccggcagctggcgttatggtcagatggtttttgcaacaaatctcacaataaaaagtttcaacatactgactatttagggaaaaatatgcgcaagatcacacaggcaatcagtgccgtttgcttattgttcgctctaaacagttccgctgttgccctggcctcatctccttcaccgcttaaccctgggactaacgttgccaggcttgctgaacaggcaccaattcattgggtttcggtcgcacaaattgaaaatagcctcgcagggcgtccgccaatggcggtggggtttgatatcgatgacacggtacttttttccagcccgggcttctggcgcggcaaaaaaaccttctcaccagaaagcgaagattatctgaaaaatcctgtgttctgggaaaaaaatgaacaatggctgggatgaattcagcattccaaaagaggtcgctcgccagctgattgatatgcatgtacgccgcggtgacgcgatcttctttgtgactggtcgtagcccgacgaaaacagaaacggtttcaaaaacgctggcggataattttcatattcctgtcaccaacatgaatccggtgatctttgcgggcgataaaccagggcaaaatacaaaatcgcaatggctgcaggataaaaatatccgaattttttatggcgattccgataacgatattaccgccgcacgcgatgtcggcgctcgtggtatccgtattctgcgcgcctccaactctacctacaaacccttgccacaagcgggtgcgtttggtgaagaggtgatcgtcaattcagaatactgacagagcgggagagcgtgacgctctcccgaatgctgtttttttaatcacacctttatcctttcgctgtcttgctgcaaactgattaagagagttttatcaaggagcagcacatgtggtatcaaaagacgctcacgcttagcgccaaatctcgtgggtttcatctggtaacggatgaaattctgaatcagctggctgatatgccgcgcgttaacatcggcttactgcatctgttgctgcaacatacctccgcctctctgacacttaatgagaactgcgatcccaccgtacgccacgacatggagcgttttttcctccgcaccgttcccgacaacggaaattatgagcatgactatgagggagcagacgatatgccttctcatatcaaatcctcaatgctgggaacatcgcttgtattgccggtacataaagggcgtattcagaccggcacctggcaaggcatctggctgggggaacatcgcatccacggcggatcgcgtcgcatcatcgcgacactacaaggggagtaaaaaatgaccatttcggagttgctacaatattgcatggcaaaaccaggcgcagaacagagcgtgcataacgactggaaagcgacgcagatcaaagtggaagatgtactgtttgcgatggtgaaagaagtagaaaatcgcccagctgtttcgctgaaaaccagcccggagctggcggagctgctacgtcagcagcacagcgatgtgcgtcctagccgccatctgaataaagcgcactggagcaccgtgtatctcgacggttcgctgccggattcgcaaatctattatctggtggatgcgtcttatcagcaggcagtgaatttactaccggaagaaaagcgtaaattgctggtacaactctgaaaggaaaaggccgctcagaaagcggccttaacgattacagcatcggcttgaggaagcgtgccgtatgcgaagcttcgcactccgcgacggtttctggcgtaccggagacgaggatttcgccgccgccactgccgccttctggtcccaggtcgacaatccagtcagcggttttgatcacgtcgagattgtgctcaatcaccacaatggtattgccctgatcgcgcagtttatgcagcacgtcgaggagttgctgaatatcggcgaagtgcagaccggtggtcggctcgtcgagaatatacagcgtctgcccggtgccgcgttttgacagctcacgcgccagcttcacgcgctgggcttcaccaccagaaagtgtggttgcggactgccccaggcgaatgtacgtcagaccaacgtccatcaacgtttgcagcttacgcgccagagctggcaccgcatcaaagaactcacgcgcctcttcgatggtcatatccagcacttcgtggatggttttgcctttgtacttaatttccagcgtttcacggttatagcgtttacctttgcactgatcgcacggcacgtagatatccggcaggaagtgcatctccactttgatcacaccgtcgccctgacaggcttcgcagcgcccgccacggacgttaaagctgaaacgtcctggcgtataaccacgcgcacgggattccggtacgcccgcaaacagttcgcgcacaggtgtaaacacgccggtataggtcgccgggttagaacgtggagtacgaccaattgggctttggtcgatatcgatcactttatcgaaatgctccagcccctgaatatcgcgatacggtgccggttcggcgatggtcgcaccattcaactggcgttgggcaatcgggaacagtgtgtcgttaatcagcgtcgatttaccggaacctgaaacccctgtgatgcaggtaaacagaccgactggcagcgtgagcgtcacgtccttcaggttgttgccgcgtgcgcctgtcagcttcagcactttttccggatttgccggaacgcgcttcttcggcacttcaatcttgcgtttaccgctcatgtactgcccggtcaacgactccggcaccgccataatcgcttccagcggaccttctgcgaccacttcaccgccgtgaacacctgcgcccgggccaatgtcgatcacatggtcagcggcgcgaattgcgtcttcgtcgtgctccaccacaatcacggtattaccgagatcgcgcagatggataagcgtacccaacaggcgctcgttatcgcgctggtgcaggccgatagatggctcgtccagcacgtacataacgccaaccaggcccgcaccaatctggctcgccagacggatacgctgggcttcaccgccggaaagcgtttctgccgagcgggaaagcgtcaggtaattcaggccgacgttaacgaggaatttcaaacgatcgccgatctctttaaggattttttccgcaatcttcgcccgttgaccagcgagtttgagattgttgaagaattccatcgcatgaccgatgctcatgtcggagatagcaggcagcggcgtattctcgacataaacgtggcgcgcttcccgacgcagacgcgtcccttcgcagctggcgcatgggcgattgctgataaacttggctaattcttcacgtaccgcactggattctgtctctttataacggcgctccatattgtgcagcacgccttcgaacggatgacgacggatggaggtatcgccacgatcgttcatgtatttgaattcaatgttttctttgccagaaccgtacaacaccactttatgcacgttcgcgctcaggctgccccacggcgcttcgacgtcgaacttatagtgatctgccagcgatttcagcatctggaagtaatagaagttgcggcgatcccagccacggatcgcaccgccagccagtgacagctcggggttttggatcacgcggtcaggatcgaaatattgctgtacgccaaggccgtcacaggttgggcaggcacctgccgggttgttaaacgaaaacagtcgcggctccagttcacgcatactgtagccgcaaattgggcaggcgaagttggcggagaacagcagctcttccgctttcgggtcgtccatatccgccactaccgctgtaccaccggaaagctccagcgcggtttcaaacgactccgcaagacgttgggtaagatcgtcacgcaccttgaagcgatcaaccaccacttcaatggtatgtttcttttgcagttccagtttcggcggatcggaaagatcgcagacttcgccatcaatacgagcacggatgtaaccctggcttgccaggttctccagcgttttggtgtgttcgcctttgcgctctttaatgattggcgcgagcagcatcagacgcttgccttccggctgcgacagcacgttatccaccatctggctgacggtttgcgccgccagcgggacgtcgtggtccggacagcgcggttcgccgacgcgggcgaacaacaaacgcaaatagtcgtggatttcggtgattgtccccaccgtagaacgcgggttatgagacgtcgatttctgctcaattgagatggcaggagaaagcccctcaatatgatcgacgtccggcttttccatcagtgacagaaactgccgcgcgtaggcggaaagggattcaacgtaacggcgctgcccttcggcatataaggtgtcgaaagcgagcgaggatttgccagaacccgaaagcccggtcacgacaatgagcttgtcgcgggggataacgaggttgatgtttttgagattatgggtgcgggcgccccgaacttcgatcttatccattcacctttcccggattaaacgcttttttgcccggtggcatggtgctaccggcgatcacaaacggttaattatgacacaaattgacctgaatgaatatacagtattggaatgcattacccggagtgttgtgtaacaatgtctggccaggtttgtttcccggaaccgaggtcacaacatagtaaaagcgctattggtaatggtacaatcgcgcgtttacacttattcagaacgatttttttcaggagacacgaacatggccagcagaggcgtaaacaaggttattctcgttggtaatctgggtcaggacccggaagtacgctacatgccaaatggtggcgcagttgccaacattacgctggctacttccgaatcctggcgtgataaagcgaccggcgagatgaaagaacagactgaatggcaccgcgttgtgctgttcggcaaactggcagaagtggccagcgaatatctgcgtaaaggttctcaggtttatatcgaaggtcagctgcgtacccgtaaatggaccgatcaatccggtcaggatcgctacaccacagaagtcgtggtgaacgttggcggcaccatgcagatgctgggtggtcgtcagggtggtggcgctccggcaggtggtaatatcggtggtggtcagccgcagggcggttggggtcagcctcagcagccgcagggtggcaatcagttcagcggcggcgcgcagtctcgcccgcagcagtccgctccggcagcgccgtctaacgagccgccgatggactttgatgatgacattccgttctgatttgtcattaaaacaataggttatattgttttaaggtggatgattaaagcatctgccagccataaaaaagaagcctccgttatggaggcttctacgtatcaggtcaaaatcattggccattgtggcggtgtctgattcatctcttctatcatcaccgactcgatgttgtgccagatagcggtgatgtccgccattgtgatgccaagcaaccccattgcgaaccaacaggcggaaacaacgcccagaccgctgctgatcaccgcaagcccgacataatcagaccgacgaaaacggatgttgagtgtgctggccagaaacatcattacggcactaagaagttgccagcgaagaagaaccacgccagtggtgagggtagccatcaaacaattcctctgaaaagagccgatgccctggacagcgcggcgttgttcacgggaggcgtggtacactctggctatcgcggggcttgcagaacacaaaaatgaaacactctgtttgtttcattaattttgtgaactatatcacaattgattgtttgttagccatattaggccgtgacttttattgctgtacagattatgtggtttttcagtggcattaagggcatatcttcccgccgcctctgcattcctgtaggaaattaattttgaatatcaatgaattattttcatccaggtgacgattagaaaggtatcaatttcaaatcaggcaaaagtgctatttataccgtaagatttatctaaagacgtcggtacccagggttttcaccttgcaatggccgggtataaacaggcaggaaattgatagcaatgagtcatcgtgcacgacaccaattactggcgttgccgggcattatctttttagttctctttcccatcattctttcgctatggattgccttcctttgggcaaaatcagaagtgaataatcagctccgaacctttgctcaactggcactggataaatccgagctggtcattcgccaggcagatttagtgagcgatgcagctgaacgctatcaggggcaagtttgcactccagcccatcaaaagcgaatgttgaatattattcgtggctatctttatattaatgaattgatctatgcccgtgataaccattttttatgctcatcgctgatagcgcctgtaaacggctatacgattgcaccggccgattataagcgtgaacctaacgtttctatctattattaccgcgatacgccttttttctctggctataaaatgacctatatgcagcggggaaattatgtggcggttatcaaccctctcttctggagtgaagtgatgtctgatgacccgacattgcaatggggtgtgtatgatacggtgacgaaaacctttttctcgttaagcaaagaggcctcggcagcaacgttttctccgctgattcatttgaaggatttaaccgtacaaagaaatggctatttatatgcgacagtttattcgacaaaacgcccaattgcagccattgttgcgacttcatatcaacgtcttataacccatttttataatcatcttatttttgcgttgcccgccggtattttggggagtcttgttctgctattactctggctacgtattcgacaaaactatttatctcccaaacgtaaattgcaacgcgccctcgaaaaacatcaactttgtctttattaccagccaataatcgatatcaaaacagaaaaatgtatcggcgctgaagcgttgttacgttggcttggtgagcaggggcaaataatgaatccggcagagtttattccgctggcagaaaaggaggggatgatagaacagataactgattatgttattgataatgtcttccgcgatctgggcgattacctggcaacacatgcagatcgctatgtttctattaacctgtcggcctccgattttcatacgtcacggttgatagcgcgaatcaatcagaaaacagagcaatacgcggtgcgtccgcagcaaattaaatttgaagtgactgaacatgcatttcttgatgttgacaaaatgacgccgattattctggctttccgccaggcaggttacgaagtggcaattgatgattttggtattggctactctaacttgcataaccttaaatcattgaatgtcgatattttgaaaatcgataaatcgtttgttgaaacgctgaccacccacaaaaccagtcatttgattgcggaacacatcatcgagctggcgcacagcctggggttaaaaacgatcgctgaaggcgtcgaaactgaggagcaggttaactggctgcgcaaacgcggcgtgcgctattgccagggatggttttttgcgaaggcgatgccgccgcaggtgtttatgcaatggatggagcaattacccgcgcgggagttaacgcgcgggcaataaaactacaggcggtggcgataatcgctgggagtgcgatcaaactgccgacggaaaacgcgggagaaggtctgctgcgagacataacccaggtccattgcgatatcaaaaatcggacgctcggtggtgcgcaactcaacggcggccagtaacaggcgacgttggcgaatgtaatcgccaagcgtctgatgcgtcaccgtgcggaacattcgttgcaagtaccactttgaatagcctgatttttttgcgactacatcaatgttaagcggctggtcaatatgctcgtcaatccatgcgataagatcctgaataattttctgatgggacataaatctgcctcttttcagtgttcagttcgttaattcatctgttggggagtataattcctcaagttaacttgaggtaaagcgatttatggaaaagaaattaccccgcattaaagcgctgctaacccccggcgaagtggcgaaacgcagcggtgtggcggtatcggcgctgcatttctatgaaagtaaagggttgattaccagtatccgtaacagcggcaatcagcggcgatataaacgtgatgtgttgcgatatgttgcaattatcaaaattgctcagcgtattggcattccgctggcgaccattggtgaagcgtttggcgtgttgcccgaagggcatacgttaagtgcgaaagagtggaaacagctttcgtcccaatggcgagaagagttggatcggcgcattcataccttagtggcgctgcgtgatgaactggacggatgtattggttgtggctgcctttcgcgcagtgattgcccgttgcgtaacccgggcgaccgcttaggagaagaaggtaccggcgcacgcttgctggaagatgaacaaaactaaagcgccacaagggcgctttagtttgttttccggtctttgtctttctctctatcccgctggtacacaggagggtttcccccgacgtcaacacacctcattcgagcacgtggtggaggttccggttggtgttgatgctttaattgtatgtcaccgacgtttcttcgccagtgtaaaagtatactttttaaccgcaatatttttgtcatctcagacgattttttatcgcaatcctgaacggtatacggctcgataacgctgcaatcttgcgcaccgacgataacgtttgcgcatcaattgcctgttttttcatcgtcaagacaataaaagagaaaaaagcagcaaacttcggttgaaaaagccgctatgatcgccggataatcgtttgctttttttaccacccgttttgtatgcgcggagctaaacgtttgcttttttgcgacgcagcaaattgtcgcaaacctggagcaggaagataacgtttcgctggcaggggattgtccgccacgcatcttgacgaaaattaaactctcaggggatgttttcttatgtctacgccatcagcgcgtaccggcggttcactcgacgcctggtttaaaatttcacaacgtggaagcactgtccgtcaggaagtggttgccgggttaacaacgtttctggcgatggtctactcggtcatcgtcgttccaggtatgttgggtaaagcaggcttcccgcctgcggcagttttcgttgcaacctgtctggttgccggactcggttctatcgtgatgggtctgtgggctaatctgccgttggcgattggttgcgccatctccctgacggcgtttaccgcattcagcctggtgctggggcaacatattagcgtacctgtcgcgctgggtgccgtgttcctgatgggtgtgctgtttacggtaatttctgccacgggtatccgtagctggattttgcgcaacttgcctcacggtgtggcgcacggcacggggatcggtatcggtctgttcctgctgctcattgccgctaatggtgtcggtctggtgattaaaaacccgcttgatggtctgcccgttgcgctgggtgatttcgcgaccttcccggtgattatgtcactggtaggtctggcggtgatcatcggcctggaaaaactgaaagtccctggtggcattctgctgaccattatcggtatctcaattgtcggtttgatcttcgatcctaacgtccatttctccggcgttttcgccatgccttcattgagcgatgaaaacggcaattcactgattggcagcctggacattatgggcgcgctgaatcctgtagtcctgccaagcgttctggcgctggtgatgacggcagtatttgatgccaccggaactatccgtgccgtcgccggccaggcgaacctgctggataaagatgggcagatcatcgacggtgggaaagcactgaccactgactccatgagcagcgttttctctggcctggtgggtgctgctccggcagcggtatacatcgagtctgcggcgggtacggcggcgggcggtaaaaccggtttgacggctatcaccgttggcgtgctgttcctgctgattctgttcctctctccgctctcttacctcgttccggggtatgcaacggctccggcgctgatgtacgttggcctgctgatgctgagcaacgtggcgaaaatcgactttgctgattttgttgatgcgatggcgggtctggttacggcggtattcatcgtgctgacctgtaacatcgtaacaggcatcatgatcggcttcgcgactctggtgattggtcgtctggtttccggcgaatggcgcaagttgaacatcggtacggtcgttatcgccgtggcgctggtgaccttctatgcgggtggctgggctatctaatctttcatcggattctgaaaacgggtggcaatggctgcccgtttttattttctccgcacattgtgtgagcttttgcgatattctgaaaaaatgagaattcaggcataacgtctttctcagatcataaaaaaacatcgcaaacagggaacgcatggaaatcttcttcaccatactgataatgaccctcgtggtctcgctgtccggggtggtcactcgtgtcatgccctttcagatcccgcttccgcttatgcaaatcgccatcggtgcgctactggcgtggccgacgtttggtttgcatgtggagtttgatcctgaactctttttagtcttgtttatcccgccgttgctgttcgctgatggctggaaaacgccgacccgtgaatttctcgaacatggtcgagagatttttggcctcgcgctggcgctggtggtggtcaccgtggtcggcattggcttccttatttactgggtggtgccgggcattccgctgatccccgcctttgcgctggcggcagtgctttctccgaccgatgctgtggcgctctccgggattgttggcgaagggcgcatcccgaaaaaaatcatgggtattttgcagggcgaagcgttgatgaatgacgcctccggcctggtgtcgttgaagtttgccgtggcagtggcgatggggacgatgatcttcaccgttggcggtgcgacggtcgaatttatgaaagtagccattggcggtattctcgccggctttgtggtgagctggctgtatggtcgctcgctgcgattcctcagccgctggggcggtgatgaacccgcgacgcagatcgttctgctgttcttgctgccattcgcttcttatctgattgccgaacatattggcgtttccggcatcctcgctgcggttgccgccgggatgaccatcacccgctccggtgtgatgcgccgtgcgccgctggcaatgcgcctgcgcgcaaacagcacctgggcgatgctggaatttgtctttaacggcatggtgttcctgctgttaggtctgcagctgccgggtattctggagacgtcgctgatggcggcagaaatcgaccctaacgtcgaaatctggatgctgtttaccgatattattctgatatatgcggcgctgatgctggtccgtttcggctggctgtggacgatgaaaaagttcagcaaccgcttcctgaagaagaagccgatggagtttggttcgtggaccacacgagaaatcctgatcgcgtctttcgccggggtgcgtggggcgatcactctggccggtgtgctctctatcccgctgctcttgccggatggtaacgtcttcccggcgcgctatgagctggtgttcctggcggctggcgtcattctcttctcgctgtttgtcggcgtggtgatgttgcctattctgctacaacacattgaagtcgcggaccattcgcaacaattgaaagaagaacgtattgcgcgagcggcaacggcagaagtggcgattgtggcgatccagaaaatggaggagcgtctggcggcggataccgaagagaatatcgataaccagctgcttacggaggtcagttctcgcgtcattggtaacctgcgtcgtcgcgccgatggacgtaacgacgttgaaagttccgtgcaggaagagaaccttgagcgtcgcttccgtctggcggcattgcgttctgaacgtgctgaactgtaccacctgcgcgccacgcgggagatcagcaacgaaacgctgcaaaaattactgcacgatctcgatttgcttgaagcgttgctaattgaggaaaatcagtaagccgaaagcgacgtaaccaggcccgaggtaatctgaaaaaggtgcaatcttttgcacctttaacaggttagctcgggctaacattcatgattctaaaacaaataagttatctctcttgtaaagtcaattcattggctgttcttcgacttaacctcaatctgcgtgttgcataatatctgcagtaatcttcatagcgactgcattaatattatcctcagtttgtgacatgccagtatgagaggtacaatcttcttcaaagaatttctgtagtgttaccagggtatcactatcaatggggatattttcctccccacggagaatagaaatgcccattccctggacgctagcctcatcaaaattaacccgatagagacgggtattaaacatacaggcttttgttaaaatagaacagttgaaatggcagttgcttaaattggcattattaaaattaacattagccatattagagccggtacatataaccatttcgaggaatgtatttgttagccacgtacaaaagagtttgctatcaattaagtttatattctggaggattgctttgttcagattgacgcgagacagatcagcatgttcaaagttaattaaatcgagtttagagaaactaaggtcggctttaaataaaataacatatggcgctattactttataaagatttacctcagccatgtacgccatataaaaatttgaatagtcaagaaaggtatttttaatattggctctattcattgctgcattgtagaattgaacatgcatagcggagcatgcatttagagttccgtcggccatttttatctgagcgaaatttgagtcatcgagaatacaattatcaaaaagtattttttccattatggcgtaataaaaattcgttttatacatattacagtcctggaaaatagcgttttgtagtcagcaacctgcaaaattcgaattggataaatcttcatctttaatcacgatacctttcaggctaaggtgtgaaaaatcgtaaccaccatttactgtctgtggaatttcgatagtattattatggacggcgacattatttataaaatataccaccttaatggatacttccttttctttactaaggtaaactcttctcgtaattctatcgtcacatttattatttgcatataaagctatatctataaaatgtttatgtattttcctgtccgtttccttcgtgatttttcctgatggtaaactatcataaattcttttcattttctgaatcaaacctatcactttttcatgatcatccatcttgaaaagagagagggctttattgtcaattaacgtgtttttatgatgtttgctgtaattatatgattttgttttctttgtatgtgatgaacttgtgaaagagtggttatcgttaatctggcaaagagagaaaaacatattatttaaaccattatagcgcataaaatatccttataattaacaagaaagaaaaggcatattctctgcattatcattttctacgactgtcaaaaatcgctcattttttaatgagtttatttgtttaatattatgggaaaaggtgatgcatgctggagaggaagagtattccccggtcaggcgaccggggaaggggagagattaatgtgcgcggccttgctcaacgccaaagccggtctgggagcggataaactgtgcacggaacagttcacgctcgcgcgcaccttccgctgagttatcggttgccgagaagaaccagatgccgaggaatgccacgctgatagagaacagcgccgggtattcatacgggaagatggctttttcgtgaccaaggatctgtacccaaatcgtcgggccgaggatcatcagtaccactgcggtaatcagccccagccagccacccatcatcgcgccacgagtggtcagtttcgaccagtacatagaaagcagaatgatcgggaagttacagctcgctgcgatggcaaacgccaggcctaccatgaaggcgatgttctgattctcaaacagcacgccgaggataatggcaatcacacctaaaatcagcacggtgattttcgatacccgcagttcttcacgttcggtcgcgccttttttgaagacgttagcgtacaggtcatgcgaaaccgctgatgcgcccgccagcgtcagaccagcaaccaccgcaagaatggtggcaaaagcaaccgctgaaataaaaccgaggaacaggttgccgcccactgcattcgccaggtgaacggccgccatgttgttaccaccaatcagatggcccgccgcgtctttatattccggattcgcaccaaccagcatgatcgcgccgaagccgataataaaggtcagaatatagaagtagcccataaacccggtggcgtagaacacgctcttacgtgcttcgcgggcatcgctgactgtaaagaagcgcatcagaatgtgcggcaagcccgccgtaccaaacatcagtcccagacccagagagagcgcggagatcggatctttcaccagcccgcccggcttcatgatgtcgacacctttcgggtgtaccgccatcgcttcactgaacagattgttgaagctaaagccgacgtgtttcatcaccataaaggccataaagctggcaccgaacagcaacagcacggctttgataatctgtacccaagtggtcgccagcatgccgccgaacaggacgtacatcatcatcagcacgccgaccagcaccaccgcaatgtgatagttaaggccaaacagcagctcgatcagtttacctgcgcccaccatctgggcgataaggtaaagcgccaccaccaccagagaaccacaggccgaaagaatacgaatcggcccttgtttcagacggtaagaggccacatcggcaaaggtgtagcgccccaggttacgcagacgttcggcaatcaggaacaaaatgatcggccagcccaccaggaagcccagcgagtaaattaagccgtcatagccggaggtaaacaccagcgcggagatccccaagaatgaggcggcggacatatagtccccggcaatcgccagcccgttctggaagccagtgatattgccgcctgcggtgtagtagtcgctacgagaacgtacgcgttttgatgcccagtaggtaatgccgagcgtaaacacgacgaaaatcaggaacataataatcgcctgccagttcgttggctggcgctctacggccccgctaatagcatccgcggcgttagctgcgaaagggagtgtggcggcaagcgccgtcagaactcttttcatgatgcttgtacctcatgcaggacttcattattaagacggtcgaattcgccgttcgcccgccagatgtagataccggtgagaacaaaggagatcacaatcactccaacaccaattggaataccgcgtgtgacgctggtgttcggattcagcggcgtgcccagccagccgggcgcgaaggcgatcagtaaaataaagccgatataaactgccagcataataatcgacaggatggtggcaaaccgttgccgtttttcgactaactccctgaaatgcgcattgtcttctatccgctgataaatagtgccattcatcacagattctccagaggtaatgtagggattgttttaattcccgctcccttatgggagaaggttaacgctcgggtaacccttgccgaatgtaggccggataaggcgttatatgccgcatccggcaatcaatgcctgatgcgacgctgtcgcgtcttatcaggcctacaaaccgttaccgattcgcatccggcaattgtgggttacgatggcatcgcgatagcctgcttctcttcaagcagcttctcgacaacgccaggatcggcaagcgtcgaggtatcgcccaggttgctggtatcgcccgccgcaattttgcgcagaatacggcgcataattttgccggaacgggttttaggcagggagtcggtccagtgcagcacgtctggcgtcgccagcgggccaatctctttacgcacccagttgcggacttctgcgtacagttctggtgacggttcctccccgtgattaagcgtgacgtaggcgtagatcgcctgacctttaatattgtgcggaatacctactacggcggcttcggcaatcttcggatgcgccaccagcgccgactcaatctctgccgtccccagacggtgaccggagacgttcagcacgtcgtccacacgcccggtgatccagtaatagccatcttcatcgcgacgcgcgccgtcgccgctgaaatacatatttttgaaggtggagaagtaggtctgttcaaaacgttcgtgatcgccaaacagcgtacgcgcctgacccggccaggagtcggtgatcaccaggctgccttcggtagcgccttccagcgggttaccttcgttatcgaccagcgccggttgcacgccgaagaacggacgtgttgccgaaccggctttcagctcggtagcgccaggcagcggcgtgatcatgaaaccgccagtttcggtctgccaccaggtatcgaccaccggacatttctcgttgccgatttttttccagtaccactcccacgcttctgggttaattggctcgcccacggaaccgagaatgcgcagcgacgaacggtcggtaccctcgatcgctttatcgccttccgccatcagcgcgcggatcgccgtgggtgcggtatagagaatattgacctgatgcttgtccaccacctgcgccatacgggcaggcgtcggccagttgggtacgccttcaaacatcagcgtggtcgcaccgcaggccagcgggccgtacagcaagtaactgtgtccggtcacccagcccacatcggcggtgcaccagtagatatcacccggatgataatcaaagacatatttaaaggtcagcgccgcgtacaccagataaccgccggtagtatgcagcacaccttttggcttaccggtagaaccggaggtgtagagaataaacagcggatcttcggcgttcatctcttccgcctggtgctgatcgctcgcttgctcaaccaggtcgtgccaccacaggtcgcgcccttcctgccagtcaattttcccgccagtacgcttcagtaccaccacatgctctacgctggtgacgttcgggtttttcagcgcgtcatcaacgtttttcttcagcggaatactgcgcccggcacgcacaccttcgtcggaagtgatcaccagtcgtgagttggaatcaataatgcgcccggcaacggcttccggcgagaagccgccgaaaatcaccgaatgcaccgcgccaatacgggcgcaggccagcatcgcaaccgcggcttccggcaccatcggcatataaatcgccaccacatcaccttttttaatgcccagctcgagcagggtattggcgaagcggcagacgtcgcggtgcagctctttatagctgatatgtttgctctggctggcgtcgtcgccttcccagatgatggcggtacgatcgccgttttcttgcagatggcggtcaaggcagtttgccgccagattcagcgtgccgtcctcgtaccatttaatggacacattacctggggcaaaggaggtgtttttcaccttctggtaaggtttgatccagtcaagaatttttccctgttcgccccagaaggtatcaggtgcgttaatagattgttgatacatcgcctcgtactgctgagggtttatcaggcaacggtctgcgatgttggcaggaatggtgtgtttgtgaatttggctcatgcttttgttctccttgtaggatgttaataatatgtggcataagcgttaaatgtaggggtattggcagttttgtttagtatttgggcgacagatcacgcaaaagtagaattgtgcaaataaacggcagggtaatttttgaaggtcagcaacaaaagttgattaattctttgaggaacatgcagttatgcattctgttgaaaaagaggaagatactgactaactctaaagtggtattttacatgcacttacaattgattaaagacaacattcacagtgtggttatttgttacacataggggcgagcaatgtcatgacagtgtaggtgcggttactgtcgtgaaaaacaataaaaaccgccattgcaacaatggcgcaattcggatgaagcccctatgacaaggataaaaataaacgcacgccgtatcttcagcttattgattccctttttctttttcacttctgttcacgctgaacaaacggcagctcccgcaaaaactgtaactgtggaagcgaagaatgaaacctttgccccgcagcatcccgatcaatatctctcctggaaagccacctcggaacagtcagagcgtgttgacgccctggcggaagatccacggctggtgatcctgtgggcggggtatcccttctcgcgcgattacaacaagccgcgtggacatgcttttgctgtgaccgatgtgcgtgaaaccctgcgtaccggtgcgccgaaaaacgctgaagatggtccgctaccgatggcgtgctggagttgtaaaagcccggatgtggcgcgtctgatccagaaagacggcgaagatggctacttccacggtaaatgggcgcgcggcggcccggaaatcgtcaacaacttaggttgtgccgactgccataacaccgcctcaccagagttcgccaaaggcaaaccggagttaaccctttcccgtccgtatgcggctcgcgcgatggaagccattggtaaaccttttgagaaagccggacgtttcgaccagcaatcgatggtttgcggtcagtgccatgtggagtattacttcgacggcaaaaacaaagcggttaaattcccgtgggatgacggcatgaaagtcgaaaatatggagcagtattacgacaaaattgccttctctgactggactaactccctgtcgaaaacgccaatgctgaaagcgcagcacccggaatatgaaacctggacagcgggcattcacggtaaaaacaacgtgacctgtatcgactgccatatgccaaaagtgcagaacgccgaaggcaaactctacaccgaccataaaattggtaatccgtttgataacttcgcccagacttgtgcgaactgccatacccaggacaaagctgccttgcaaaaagtggtcgcggaacgtaagcagtcgattaacgacctgaaaatcaaggttgaagatcaactggttcacgctcacttcgaagcgaaagcagcgctggatgcaggcgcgacggaagccgaaatgaagccaattcaggacgatatccgtcatgcccagtggcgctgggatctggcgatcgcttcccacggcattcatatgcacgcaccggaagaaggtttacggatgctcggtacggcgatggataaagcggcggatgcacgcaccaaactggcgcgcctgctggcgaccaaaggcatcacccatgaaatcgagatcccggatatctcgaccaaagagaaagcccagcaggccattggcctgaacatggaacaaatcaaggccgagaagcaggacttcatcaaaacggtgatcccgcagtgggaagaacaggcacgtaaaaacggtctgttaagccaataaccccgttccgcctcgcaaggggcggaaaacacaatggagtgaatatgagcgtattacgttcgttattaactgccggggtgctggcgtcgggcctgttgtggagcctgaacggaattaccgctacccctgcggcgcaggcatctgatgatcgctacgaagttacccagcagcgtaacccggatgccgcctgtctggactgtcataaaccagataccgaaggtatgcatggaaaacatgcttccgttatcaacccgaataacaaactgccggtcacctgcaccaactgtcacggccagccatcaccgcaacaccgcgaaggggtgaaagatgtgatgcgctttaacgagccgatgtacaaggttggagagcagaacagcgtctgtatgtcctgtcatctgccggaacagttgcaaaaagcgttctggccgcacgatgtccacgtaaccaaagtggcgtgcgccagctgccattccctgcatccacagcaagatacgatgcagacgttaagtgacaaaggacggattaagatttgcgtcgattgccacagcgatcagcgcaccaatccgaactttaacccggcgtctgttccgttgcttaaggagcagccatgacctggtctcgtcgccagtttctcaccggcgtcggcgtgctggcagccgtcagcggcaccgcagggcgcgtggtggcgaaaacgttgaatatcaatggggtgcgttacggcatggtgcatgacgagtcgttatgcatcggctgtaccgcctgtatggatgcttgtcgggaagtgaacaaggtgccggaaggcgtctcgcgcctgacgattattcgtagcgagccgcagggcgaatttcctgatgtgaaatatcgcttcttccgtaagtcttgccagcactgcgatcatgcgccgtgcgttgacgtctgcccgaccggtgcgtcttttcgtgatgccgctagcgggattgtcgatgttaatcctgatctctgcgtcggttgtcagtactgcatcgccgcctgtccgtaccgcgtgcgctttatccatccggtcacgaagacggcggacaaatgcgatttctgccgtaaaaccaatttgcaggccggtaagctgcccgcgtgcgttgaggcttgcccgacgaaggcgctgacgtttggcaatctggacgatcctaacagtgagatttcgcaactgctgcgccagaagcctacttaccgctacaagctggcgctgggaaccaaaccgaagctgtaccgcgtaccgtttaaatacggggaggtgagccaatgacgcagacttccgcatttcattttgaatcgctggtgtgggactggccgattgccatctacctgtttttgattggtatttctgccggtctggtgacgctggccgtgctgttacgtcgcttctacccgcaggcgggcggtgcagacagtacgttgctgcgcaccacgctgattgtcgggccgggcgcggtgatcctcggtctgttgatcctcgtcttccacctgacaagaccgtggaccttctggaagctgatgttccactacagttttacctcggtgatgtcgatgggggtgatgctgtttcagctctacatggtggtgctggtgctgtggctggcgaaaatctttgaacatgatttgcttgccctgcaacaacgctggttgccgaagctggggatcgtgcaaaaggttctgagcctgctgacgcccgttcatcgcggactggaaacattgatgctggtgttggcggtgttgttgggggcttataccggctttctgctgtcggcgctgaaatcgtatccgttcctcaataacccgatcctgccggtgctgttcctcttctccggcatctcgtccggtgcggcggtggcgctgatcgccatggcgatacgccaacgcagtaacccgcattccacggaagcgcagtttgtacaccgtatggaaatccccgtggtatggggtgaaatcttcctgctggtggcgttttttgtcggtctggcgctgggcgatgacggtaaagtgcgtgcgctggtggcggcattaggtggcggtttctggacgtggtggttctggcttggtgtcgccgggctggggctgattgtgccaatgttgctcaaaccgtgggtcaatcgcagttccggcattcctgccgtgctggcggcgtgtggggccagtctggtcggcgtgttgatgctgcgctttttcattctctacgccgggcagttaacggtggcgtaagccagaaaagaggtggtttctggacgtattccttcctgaagtcggttttctggcgttgttgttaagtctcggggtcaacgtgttgaccccgttgacggcctttgcgggagtgcggttgcgctggcctgccatgatgcgactcacttgcatcggcattctggcgcagttcgcgctcctgctgctcgcctttggcgtactgacgtattgttttctcatcagcgatttctcggtcatttatgtcgcccaacatagctacagcctgctgtcgtgggaactcaaactggcggcggtgtggggcggccatgaaggttcgctgctgctttgggtgctgctgctttccgcctggagcgcgctgtttgcctggcattatcggcagcaaaccgatccgctatttccgctgacgctagccgttttatctctcatgctcgccgcactgctactgtttgtagtgctgtggtccgatcccttcgtgcggatatttccaccagcaatcgaaggccgcgatctcaatccgatgctgcaacatcccggtcttatctttcatccaccgctgctttaccttggctatggcggtttgatggtagcggcgagcgtggcgctggcgagtttactgcgcggcgagtttgatggtgcctgcgccagaatttgttggcgctgggcactacctggctggagcgcattaacggcggggatcatcctcggttcttggtgggcctattgcgaactgggctggggcggctggtggttctgggatccggtggaaaacgcctctttattaccctggctttctgccactgcgctgctgcacagtttgtccctgacacgccagcgggagattttccgccactggtcgctgttgctggcgatagtaactctgatgctgtcgctactgggtaccttaattgtccgttctggcattctggtttcggttcatgcgttcgcactggataacgtccgcgccgtgccgttgttcagcctgtttgcactgattagccttgcgtctctggctctgtatggctggcgagcgcgggacggtggtgcggtggtgcgtttttcggggttatcgcgggaaatgttaatcctcgctacgctgttgctgttttgcgcagtgctactgatcgtgctggtgggaacgctttatccgatgatttacggcctgctgggctggggacgcctctccgttggcgcgccgtattttaaccgcgcgacgttaccgtttggcctgttgatgctggtggtgattgtgctggcgacgtttgtctctggcaaacgcgtgcagcttccggcgctggtagctcatgcgggcgtgctgttatttgccgcggggatcgtggtttccagcgtcagccgtcaggagatcagcctgaatttacagccgggtcagcaggtgacgctggcaggatacaccttccgttttgagcgcctcgatctgcaagccaaaggcaattacaccagcgaaaaagcgatagtggcactgtttgaccatcagcaacgcattggtgaactgatgccggagcggcgtttttacgaagcacgtcgtcagcaaatgatggaaccgtcaattcgctggaacggcatccatgactggtatgcggtcatgggtgaaaaaaccggagcggatcgttacgcttttcgcttgtatgtacaaagcggtgtgcgctggatctgggggggaggattgttgatgattgcgggcgcattgttaagcggatggcgggggaggaagcgcgatgaataaaggacttctcacgctactgctgttatttacctgttttgcgcgcgctcaggtcgtagacacctggcaattcgccaatccgcaacaacagcaacaggcgttaaatattgccagccagttacgttgtccgcagtgccagaatcaaaacttactggaatccaacgcgccggtggcagtcagtatgcgccatcaggtttacagcatggtggcggaggggaagaacgaagtcgaaatcattggctggatgaccgaacgctacggagattttgttcgctataacccaccgttaacgggtcagacgctggtgttgtgggcgctgccagtggtgttgttactgctgatggcactgatcctctggcgagtgagggcgaagcgatgaaagagcccaaaataccggtgaaaatgctgacaacactcacgattttgatggtatttctctgtgtcggcagttatctgttaagtccaaaatggcaggcggtacatgcggaatatcagcgtcagcgcgatccgctacatcagtttgccagccagcaaaccccggaagcgcagcttcaggcattgcaggataaaatccgcgctaatccacaaaacagcgaacaatgggcgttactgggcgagtactatctgtggcaaaacgattacagcaattcgctgctggcgtaccgtcaggcgttgcaactacgtggtgagaacgctgaactgtatgcggcgctggcgacggtgctttattaccaggccagccagcatatgaccgcccagactcgcgcaatgatcgacaaagccctcgcgctggactctaacgaaatcaccgctctgatgctgctggcttccgatgcgtttatgcaggcgaattacgcgcaagccatcgaactatggcaaaaagtgatggatctcaactcaccccggatcaaccggacacagctggtcgagtcgattaatatggcgaaattgttgcagcggagatcagattaatcatctggtgatgaagattatgttattgagttgtataaaaaataatcgaatgaacatatgccaaaaataatcaccaatcagtattattgcagattaaacaaataaaaatctttccataacaaatggttattcattaatcctgccataaactcgcgttattatgcattaatgcagcgaaaagctctgttgttaaagggttgcgcaacataccgcgcaaatgatactgatcataagcgttaaaaaaatctacaaaccaacgcaacacaattcatgccctggcagtatgtcacgttctcgcgtttctgaacggggaacggcgctccattgaggaagttattctgatgaaaagtataaaattcagcctggcctggcagattctgtttgctatggtgctgggcattctcctgggaagctacctgcactaccatagcgacagccgcgactggctggtcgtcaatttgctctctccggcgggtgatatcttcatccatctgatcaaaatgattgttgtgccgattgtgatctccacgctggtggtgggtatcgcgggtgttggtgatgccaaacagctcgggcgtattggcgcgaaaaccattatttacttcgaggtgatcaccaccgtcgccatcattttggggatcactctggcgaacgtcttccagcccggtgccggggtggatatgtcgcagctggcgaccgtcgatatctcgaaatatcagagcactacggaagcggtacaaagcagttcccacggcattatgggcacgattttgtcgctggtgccgacgaacattgtggcgtcgatggcgaaaggcgaaatgctgccgatcatcttcttctcggtgctgtttggtctggggctttcctccctgcccgcgacgcatcgtgaaccgctggtgaccgtgttccgctccatctctgaaaccatgtttaaagtgactcacatggtgatgcgttatgcaccggtgggtgtgtttgcgctgattgcggtgacggtggctaactttggtttctcttctctgtggccactggcgaaactggtgctgctggtgcatttcgccattctgttcttcgcgctggtagtgctgggaattgtggcgcgcctgtgcgggttaagcgtctggatcctgattcgtattctgaaagatgagctgattctggcgtactccactgccagctctgaaagcgtactgccgcgaattattgagaagatggaagcctacggagcaccggcgtcgatcaccagcttcgtggtgccgaccggttactcttttaaccttgatggttcgacgctgtatcaaagtattgccgctattttcatcgctcagctgtatggcattgacctgtccatctggcaggaaatcattctggtgctgacgctgatggtgacctcgaaagggattgctggcgtgccgggcgtgtcgtttgtggtgctgctggcaacgctgggtagcgtaggtattccgctggaaggcctggcgtttattgctggtgttgaccgtatcctcgacatggcgcgtactgcgctgaacgtggtgggtaatgcgctggcggtgctggtgattgccaagtgggaacacaaatttgaccgcaaaaaggcgctggcttatgagcgtgaagtgctgggcaaatttgataaaactgcggatcaataattgaagattgccggggttatccacccggcaatgtgtggatgcctgatgcgacgctggtgcgtcttatcaggcctaccttaaccgttggttaatttttcaaactcttcacacccggtatcaaacccttccatacagctcaggttcaaccagtgcagcgccttttgtttgttcttctcgataaaaccttcctcaccgtttaagaacatcattcccgcccagtactcggaataaccggttcgggaaattgcagagctgcgtttgaaataccaggttgccttgtcatcgtcggccttaatgcccacgccgttggcgtaaatcaaaccaagcagcatttgggcatcgacggcggagtcattctccagatcttccgaggcgttttctaacagcgaaatcgcctttggataatccggtttacccgcttgagtatttaccagaatatgcgccagcgttacttcaccttctttactgcccgcttgcgccgctttctctgcaagaacttttgcttgtggatagtccagactgaccggattggtgattttgatctgcgccagcagcgcgcaggcatcagcatcaccgctgtcggcggctttctgtgcccaatattcggctttgctcaaatcgccggagctaaaccagctgtcggcaagaaaatattgtgcgcgtcggtccccggcctctgctgcctttaaatactggctgccaggctcggagtcgttcgcgtgggcaaagaatgtcaaaaacaacatcaatgcgataatttttttcattttgataatacgattgggtagggagtaaccagtataaagagttcgaatggataaaaaaacagcctccgaaaggaggctgtagaaaggactgtattacgccagtgccgcttcgcgcaggcgagttttcaacttgttgtactcgtcaatcacgtactgctcggcggcgcgctgatcggcgatcggctcgacgcgcacggcgcagtatttgtattccggcgttttcgtaatcgggcttaagttttcggtaaccagctcgttacaggcaccaatccaccactggtaggtcatgtaaatcgcccctttgttcggacgatcgctgacctgcgcacgggtgataattttgcctttacgcgagtgcacccaaaccaatgcctcatcttcaatacccagacgtttggcgtcttcggtattgatttgtgcgtagccaggttcatcagccagcgccgccagtgccgcacagttaccggtcatcgaacggcaagagtagtgaccaacttcacgcaccgttgacagtaccatcgggtactcgtcggtgagtttgtcgattggcgctacccagtcgcaggtgaagaactgtgccagaccgttcggggtatcaaacttctctttaaacagataagaagtcccctgatcggcatctgaagtatcgcggcaaggccactgaatgaagcccagttcgcccattttctcgtaagtcgcaccgtagaaatccgggcacagatgacgcaactcatcccagatctcctgggtgttgttgtagtgcatcggataacccatacgggtggcgatttcactgatgatttgccagtccgttttcagatcccatttcggttcaactgctttgaagaaacgctggaagccacggtcagccgcagtaaacacgccttcatgctcgccccacgacgttgacggcaaaatgacatccgccgccgacgcggttttggtcataaagatgtcctgaacgataaccagttccagatcttcaaaggctttacgtactgccgacagctccgcgtcagtttgcagcggatcttcgcccataatgtacgcggcacgcacttcgccatgcgctgcgcggtgcggcagctcgctgatgcgataaccggtatgagcaggcaggctttccacgccccaggctttggcgaatttctcgcggttagccggatctttcacgtactggtatcccggatacgtatccggcagcgcgcccatatcgcaggcaccctgcacgttgttctgaccacgaaccgggtttacacccgcatgcggcttaccgaggttaccggtcagcatcgcgaggctggtcagagaacgcacggtttccacgccctggtagaactgggttacacccatgccccacaggatggcggcgcttttcgcctgggcatacatccgtgccgcctgacgaatctcactggcgctgacgccggtgatatcttcaaccgactccggcgtgtagccttcaacgattttacgatactcttcaaagccttctgtacgggaagcgacgaacgctttgtcgtacagattttcttcaataatgacatggcccatcgcattcaacagcgcgatgttcgagccgtttttcagtgcaatgtgcatgtcagcaatgcgcgcggtttcaattttgcgcggatcgcagacgataattttcgccccgttacgtttagcgttaattacgtgattcgccacgattgggtgggaatccgccgggttgtacccgaaaacgaacactaaatcggtattatcaatttcgttaatagcattgctcattgcgccattaccgaccgattggtgcagacctgcaaccgatgggccgtgtcagacacgagcgcagcagtcaacgttattggtaccaataacggcgcgcgcaaatttttgcattacatagttggtttcgttacccgtaccacgcgaggagccggtcgtctggatggcatccggaccgtacttctctttgatggcgctcaggcgctcggcaacgtaattcagtgcctcatcccaggaaacaggttcgagtttgccgccacgctggcgacggatcatgggggttttcaggcgcggggtcaggatctgggtatcgttaatgaaatcccagccataataacccttcagacacagggtaccctggttggttttcccctgcgctgcctccgcccggacgattttgccgttatcgacgaccaggttgattttgcaacctgatgcgcaataggggcaaaccgtgacgacttttttcatcggtctcgctccagttaatcaaatcacgcatacgcgctctcgactacagtatgcatcttttatgccacattttatttggggtcattccctgatattacgggcactatttattcaaaactctgacgaaaaacaggctgtcgtcagttttgacgtgacgaaacgaaataccgcgtgacagccatcacgcggcagacattttattttttctcgacgacgggagccgcctgatacccgccgcccagcgatttcatcaactgaatgctttggatcacccggcggctgtccagcatcagtaatgacatctcttcggcaagtactggcaaccgggcttcagtggcctgtaagcggctggttaagccgcgctgataggcggcctcggcagcgcgctgggtgaagcgcgttgcttccacgcgttcagcctgcatttctcgctcgtcgttgagcgtttgcagacgcgtgccgttgacggcaacgtcacgcaccgcgttcagtactgactggttgtaacgttcaatcatcatgttgctggcggcgcgcgtgccttcgagattggcattcaaccgtccaccgtcaaacagcggcaatttcagacccgggatgaagttgaactggcgactggtttttttgaataaggtatccaggtggatggcatcaaggccgaaaaacgctttgatatcaaagctcgggtagaacagcgcccgcgcggaatccacctgatctaatgacgcctgaacataccagcgcatggcttgcagatccgggcgtctggcgagcaactcataagagagtgtcgccggaatgccggtctggactcgtggtaatgccaccggtttgatctccggcatatcgctggcccccgcgccaatcaatgcacgcagagattctcgcgtttcggtgatttgccctttgacggcagcaatttgtttatcgaccgccagaatctgtgcccgcgcgccgtggaaaggcacttgtgcttccagaccgtgcgccactttactctggtgcgctttcaccgcgtaatcaatcacatcgcgagtttgttctaacagatcgagcatctgatagctggcctgcatactgtaataaagctgcgctacgcccgtggtcagcgatagctctactgctgcggtttctgccagcgcggcattatgcgcgccaatggcggcggcaaccgctgagcgatgcacaccccacaaatcaagatccagtccggcaaacaaacctactgtggcttccgtatagtacggcccgtccatacccagtgcgggcgcatccatcgcataagggcttaaaaagccgttcgccgagacgcgttggcggttgagcatccctaacgctgcgacctgtaattgtgaaccggcatctaacaaatcggcctgggactgcgctttttcttcccgcagtttcgcttcggcgagggtgtgtgaaccacttagcgtccgttggatcagcgcatccagctgcgggtcattgagttgtttccaccactgcgcctgcggccagccggagctggcaagatgaatatcgtcggccagtttgatttgttccggtttgagctgttgatgaggtgcagaatccttacgtaccagggcacagccggaaatcagcgtcgtgctgccgagaatgctgcacaacagcagacgtgaaagttgacgattgatcattgcgtggctccttgtgcctgttccgtggcgggcgttaatgccggggctgtccagtctggcaagcgggcgaaaagctggcagacgtgttgctcctgttttaataaggtgggcaggatggcctgcgaggcgggtgtctcttcaagcgttatttgaggagaacggctgagtgcggttgccagaccggcagcgtatttctccagggcgtcggcaaactgagctgctctgtccggctgtagtgcgttatccagcgcctgcgccgagttccaggtggcatcccaggcgtgaagaagatcgcggccctgacgaataaccgtttgcgaacgttcaatcagtaaggcgcgttcttcgctgtccagttgacgctccagcgccacgcgttggcacatctcttcacaggcattaaacgccgcatgcagaccgatacgaatttgcagataagtgcgcagagccgtgacttcctgctggcgtgggatccgcattactttacttaacatacccagcgtgccagccagtttttgcggcagtgtgcgcgcttcactttcaggccagacaaaggtgtaaatcaccgcggacaccacggtaccaatgatgatacccatggcgcgatcgcgaatttccaccaggtcgtacaccgggccaaaaacgttttcgagcgtggcgagcgcgaaggtgaccaccatctgtgtgccgatataagaagagcgttcagagctggtggcaatccatgcgcccaacaggaaaatcggtgccagcacaaacagcaattcgacaatattgtccagccagggcatgaccagtagcgtgaataacagcgccagaatcgcgccgcaaaaggccccgccaaaacgcagcaccatcttctggtacgacgaaccgacatttgggttagcgacgatcacgcatgtcagcatacaggtgtgaatgccttcccagtccacgccgctgtagaaggtgtaacagatcaaacaggcgagcagtgtttttaccgcgtagcgcatatagtctggattggtaaaagcatcggcgaccattgatggcggtttggcggcgggcgttggcggcgtattcgggtccatctggcccagttgtaacaacgtctggcagatattctccaggttacattcccgtgccgccatcgcttcactttcagtgatccgccagtcgctttgccagcactgaccttcagcaacggcatgctgcagcttattgatttctgaggctaatttttgccgaaattcaataattgcctgagaatcagcaaaagaggtgggatcgtagcgattcagcgtcgagtaaatgtaggttaccgttgccacgcagctttgccaccatgcgctttgagttcgccagttggcatcgtccgcgagacaaaagacattcagtttttgcagcgccagcgcctctctttcaatccgcgtttcgggtagcggtgcgaggctgtccgtcaggtggctaatggcatcatcaagccgatcattaagcgcctgatgcatttgcgaaatggcacgactgggaaaccacagcacgccgattaacgtcatcagcaaggttggatagaggccaacaacgatacaccatagcgttaagcgcacgaccacttccggatagtcgagcatggcggggaaggtttgcccgtaaatggcgacaatggcgacggcgaaaaagaccagtcccagccgatgggtgcgcatcaaaaacatacagcccatcaggatcggcccggcgatgatcaatcggatcaacggttcgccgtatgaccatttgtagatcaaaaacaggctgccgatctccagcaccgtggcaaccacaaacaagatcgcgacaaatttggtgtaaaacgcgttcgactgaataccgtaaaacagcactgccagcgataacgccacaaaagggatctcaaaagtcatcgagatcagaatcaccagcaggcagcctacccagagttgcacgatctgcggcacgcggccgggtcgccgctcgcttaactcttcatgaaagaacgccagcagcctgaccaccggtaatggcagggagttgagcgcgctcattattgcggctcaagattagcgactgccgaagcgccgatgcggaacatttccgggtcaggtttatcgaccatgattttgaccggaaaacgctgggcaacgcggacccagttaatagagcgagaaactttcggcaggccgcccagcaccaggccgccgtcatccggtagcacgccgtagccaatcgaatccactttaccctcgaaggttttgccgctgtcactcatcaggcgaatcgttgcgggtgtacctgagcgaatatttttcagatcggtttcgcggaagttggcgatcacgtaccagtgacgagtatcgattagggtaaaaatagggcgcatcgtagatgcaaactgcccgacggaggttttgagggaaatgacccggccatcaaacggcgcgcgaacggtcgccatttccagatgcagtttggtcagggcaatatccgcttcgaccgccgcacgctgggcaactaatgcatccacgccgctgacggcgctggcggctgactgcgcctgcaacaatacagcattaagatcggcttctgcagcgcgctgcgcggtcctcgcacggtcaacgtcttccgctgagacaaaaccttctttcagtaatggctcggtgcggcgtaatgtatctgtggcctgtttcgcggcggcacgggctttttctaccgtggcgttaaccgagtcggcaccaaactgttgcgcgtcaacgctacgctgggtgagcataatttgcttatccagcgccgcgagggaggcttcagctttcgccagattggcttcgtacgggcgcgggtcaatgcggaacagcaaatcgccctgtttgactgcctggttgtcggtgaccgccagttctacaatgcgaccgctgacttccggcaccacatcaatggtatctgctgacgcgtaagcgtcattagttgatggcgcactgtctacgcgccagataacgaaaacaagggcaaccagcgccaacgcaaccactaacagagcagggaatttactgcgaggagcttttttcggcgtactttccatgagcgcgtctcaaatagattagaaaaatgccagccagaacagcatggcgtagagagcaaaaagggcggtataaataattccgacaaatgccagattgatatttgcccgctgaataactcgcctcgtgatgagcgtcaaaataaggctggcaatggcgcagaaaaaccagctgggataataagcgccgatcaccgggattgccggagataatgagcatcccgaaaccatgaagacgggaattatccaggctgtttttttgagttgcatcgccatgcgagagagaactgttggcatattaaatacatcctgtctgctgcgaacaatatctgtagtgaatatcaacatccattgaaggcgtcagtatggctattttcttgatgaataaaaatagctttattcagccaccgcattcataacttatatattttatttattaattggctgtatatatttttaaaataaatgcttttgggggcttcagcgcccccaaaagcgagtgacattaatttggggttacgatattcacccacaaatcgaaattatccagacaggcgataatttcttccagtttcgcgccattgccaataattttggctttcttcgcttttaccagatccgccattttggcttgcccggtcagcacggcgtgcagatcttcacggctgatgtagaaagaggcgtcagcttgggattgcagtgttttacggtagttaagcacgctatcgttcagcgtcaggttgaggttatcgccattgctcatattgaagttcaggctgatatttttacccgcggctttcgcgctatcgaggcgaacggacataaagtcgaacagcatttcgaccgacatcccgcgaatggtgtccggggaaccggtggtgccgtggctgaacttatgcaccccttcgcgcagctctttcgcgccggtcaggtagaaaccgcgccaggtggcggactcggcctgatagcccagctgttcaaagttattcgcttgcagattcttcgcgacctggtcacccgggttggcggcaatcacctgtttcagcagttctgccgaccagcggtaatcaccttgcttgttcgcttcttgcgccaggttgatgacacgggcagaaccgcccagcgcctgcacgtaacgtttacccatctccacctgaccatacggatgcaggttagccgggttaccgtcgtaatagccaagatagaagttatacaccgcgcgggcgttgtggctgacagaaccgtaatagccacggctggcccagttattggcaagtgcaggcggcagtttaatcatgtcgccgatttcattcatggtgtagccctggttcgccaggtgcagggtctggtcgtgaatgtacttgatagtatcgcgatatttaccaatataatcattgatatgcttattgccccagaccggccaggtgtgcggcataaacaggacttccgcgtcgttaccccacatatccagcgtttcgttcagatactcggtccacttgctggtgtcgcgggttttcgcgccgcgcagagtgtagaagttgtgcagggtatgcgtggcgttctcggcggtacacagcgctttcagggccggaatatagaagtgcatttcggctggtgcttcgctacctggggtcatcaggaagtcaaactccaggccgtcgataatcatcttctcaccggttttggtgatggttttgttcggtgcgatgatgctcgggtagcccgatgccagcgttacgccaagaccattgccgatgttaccctgagggttatgcgccagcagcaggccgtaggagtaaagtgcacggcggctcataatattacccgccagtacgttttcgctgatggcttcgtccataaagccagcaggggcgataacctgcactttaccggatttcacatcggcttcagagataatgcctttcacgccgccatagtggtcggtatggctgtgggtataaataaccgcaacaatcggtttttgcgggcgattttggaagtaaaggtcaagggcggcttttgcgctcggtggcgtcaccagcgggtcgatgacaataatcccggtatcaccttcgataaaggtgatgttggagatatcctgaccgcgaacctggtacattctgtcggtgactttaaacaggccggaaataccgtttaactgcgactgacgccacaggctagggttaacggtttcgggcgcgggcgcattgatatcaaatttataatcttccccgcgataatatggtttgccattagcatcgcgcagaataccttcatccagcagcggagcgataaatccacgctgagcgtcgtcaaaatcctgacgatcgctaaacggtaatgatttggcgtaattctgattaacctgttgggtatattgagtggcggctttcgcttcctctttcgcgttagcggtatttaccatcatgccgctggcggcagttaacgcaataacaattctgctcaaacggaataaccgagagttattcatataaatctccatttatcatttatgtcgtaaatatgtaatccatgcaaaatacgtcatttaaagctggggttatcataattgggaatttgcgactttaataagtggaagtgtgagctgaacgatccattttattaggcatttgtgctgaatggggaaaattacgcgaatttattatctctgtaaataatatgaggtgttttatatatttattatatatattgtacttcggcaaatactgagcacaatttatcaatgcaaccggtgtttctttttaaaaaacgtaccggagcaatgggcggtcatgtcgctggcaccgcaggattctgcgttgctgtgccagccttttattcatggtcaatgagtgaggtgattgataaagacaccaggtcgtcagagcgcactgattatccgcattatgccagtgaagttgcactggcttttggttcacgagtggttggcctcgaactggcaaaaatgattgtggatgcgtggctgggcgcacagtacgaaggcggtcgtcatcaacaacgcgtggaggcgattacggcaatagagcagcggagaaattgagattcatccactacttgcatggatgagtaatgactaatgtggatagagtttctttttgaggttggctaatgaaacgctttccgctatttcttttattcaccctgctcacgctgtccaccgttccggcccaggctgatattatcgacgatactattggtaatattcagcaggcgattaatgacgcttataaccctgaccgtgggcgagactatgaagattcgcgcgacgacggctggcagcgtgaagtgagcgacgatcggcgcagacaatatgacgaccgccgccgccagtttgaagatcgccgcaggcagctggacgatcgccagcgccagcttgatcaggagcgtcggcaactggaggatgaagagcggagaatggaagatgagtatgggcgatgaggttgggtatggagcaggcatcgcccctcaccccaatggggagagggagaaaacgagcgcaatattcaatatcgagcacaatcggtcccctcgcccctctggggagagggttagggtgagggggccagcgcgcacattccctctcatcacgccaccccaatctccatcccatcaaaccccacctcaaaccctgacggtagtgcgttttccatcagccacgcatcaaactggtggctgatatgggtcagaatcacctgtggcgagcggataacctgattcagcgcaagcacggtatttaaatcacagtgattacgcggtgcatccgcgcgcggcgggtgactgcaatcaatcaccatcacctgcggatgattattgagtaaaaatttcagcgttttttccggcaggccagcggtgtcagacagccacgccacccggctatgtgccgtttccagcagataaccgaaggtcagttttgagtggttaagcggcagcggcgtgacctgcaacccctgcaaatcaaacaccacaaacggttccactgtgtggctgaaatcaagcaggcccggatgtttaaacagatcgtcgcagccctgttcatccggcgggccgtagaccgggatcacatcgcccacgccccagcgtagcggaaatagcccctggacgtgatccatatggtagtgcgtcagcaaaaactgctggaacgatccaggcgaccagcgatcggtgagatcgtgccgcccggcgtcgatcagggtgatcgcgtcgttaaacttcactacgccgctgcatggctggcggcgatactgcggcgagcgccgcgctctggcgcaggccgcgcactcgcagccccatgccggaacgccctgtgcgccgccagtgccggtgagcgtgagggtcaggctcatgttacagcgccttggtgaagcggaagtggctctgctcgtagccttcacgcaggtaaaaacggtgtgcgttgtggcgcttcacgttggtggaaagctcggtcatttcggccccggcctggcgggcttcttcttctgcccatgccagtaatttactgccgacgttcagaccgcgcgcctgcggcatcaccaccagttcttgaatttcgccgatccagttgacatgatgcagatgaaactgcaaatgcaggccgatcatgccgacaacttcgccatccagcagcgccagatggtagcgcatgtttgggtcgcgcaggttggcgttaaagcccacgcgaaacgcatggtggtcaaactccgcctgttttagctcacaaatcagcgcgtaaaccgcgtcggtatcgtactgcgtggccgggcgaagctcacaagcaggcatggtgtttctccttctgatggatcagcgtcagcagcgtgtcgaccgactggcgcaggctgccgtcattgttgagcgtatggcaatcctgtggagtatagcgggcggcgcgcgccaggcgggcgttaatttcactggcgttttcacggccacggttttccaggcgctggcgcaggatctccggcgaaacctgtaaacagacgggcagcagcgccgattgatagcgcgcccgtgcctgcggcaaatgcgcgcgtgaaccgttgacgactacgtcgaatccagcgtgcagccagaggtcaatctcgatgccgacgccataatacagaccgttagcgtgccagcttaaggccagcaggttttgccccgcgcgggtaaaaaactcccgctcactcagggcgatatggttttcacttccggcgctggcgtcgcgcgtgatgtagcgatgcgccaccagtaactgcgtttgttcccgcaggcggagttccgccagcaggctgtctttcccggagccggacggccccattaaccaaatcagttttcccatcatcagaacacccttttaccctgacgccagacgtggtcgatatgaatgtgattgccctggcgatgcgccagcaccaggtcagcgcgtttaccctcgccaatcaccccgcgatcctgaagattcagcgcctgcgccggatttttggtcaccagcctcaccgcctgcggtagcgtaaagcggttgctctcgtcatcggcgacgcggaacgccgcatccagcaggctggcggggtagtagtcggaagagaggatatccagcagaccaagctgcgccagttcactggccgccacattgccggagtgcgagccgccacgcacgatatttggcgcacccatcagcacgttcatgccatgcttacgcgaggcttccgccgcttcgaacgtggtgggaaattcggcgatcacgctgccaagttggtgggattcggcaacgtgggcgtgtgtggcgtcatcgtggctggcgagcgcaatttgtcgcgcgcggcacagggcggcgatggattcgcgattcggctgcgaccagcgtgcggcgagcgccaattgctcttcttcgtactgctgcatctgcgcatcggtgagggagtatttgccctgataatattcgcgatacttctcgcggttagcgaactggcgctggcccggtgagtggtccatcagcgacaccagcgtcaccggttcgcgctgaaccagtttttcaaacagcggcagtgtggtgtgatgcggcagttcgcagcgcaggtgcaggcggtgctcggcgcggttgacgccgcgtttctgcgtctcttcgatggtgttgatcatcttctccagattctccagccgatcgccgccgtcgcgcacgtcgccaatcgccaccgcgtccagcacggtggtgatgccgcttgccaccatcagcgcgtcgtggctgctcatcgccgaatgggcgggccagtcgactttcgggcgcggggtgaagaatttatcgaggttgtcggtatgcagctcaatcaggccgggtagtagccagccaccttcgccgtccatcgcttctggcaggcggctctggctttcggcaaaggcgcggatttcgccatcctgcacctccagcgaaccgtgcaccacctcgttttccagcaccagcttaacgttattgataatcatgaagaggctcccattgggtgcaggcggtcggcgacgtcattacgtacagcttcgtcatggaagatgccgacgatggctgcgccacgggctttggcttcgtgaatcagttccaccaccgcggcgctgtttttggcgtccagcgaggcggtaggttcgtcgagcagcagaatggggtagtcgacgataaagccgcgggcgatgttgacgcgctgctgttcgccgccggagaaggtcgatggtgccaggtgccacaggcgttccggcacgttcaggcgggtgagaagacgcgcggctttagcggcgcaggcttcacgcggaacgcctgtatcgagcagcggctgcatcaccacttccagtgctgagatacgcgggatgacgcgcagaaactggctcacccagccgatggtagttttgcggatctccaccactttgcgcgctggcgcggtgaccaggtctacccattcgtcaccgtgtttgatctggatttgcccttcgtcgggcagatagttggcgtacagcgagcgtagcagagttgatttgccgctgccggaatggccgtggagcaccacgcattcacctgcgttgacggtgagcgaggcgcgttgtaagacgggcaggcgcacgccgttttgctggtgcaggatgaaggttttactgacgttttgtacgttaatcatttttcgcctcgtggttcgggtgtcggatgcgacgctgacgcgtcttatccgacctacggggagcgcatttgtaggccggataaggcgtttacgccgcatccggcaccggctcaattctgcaaaaccgatgacaccagcagctgtgtatacggatgatgcgggtcgtcgagcacgcggtcggttaacccactctccaccacttgcccctgcttcatcaccagcaaacggtccgccagcaggcgggcgacgcctaaatcatgggtgacaatcaccaccgcgaggttcagctccaccaccaggccgcgcagcaggtcgagcaggcgggcctgcaccgacacatccagcccgccggtcggttcatccataaacaccagcttcggatgcgtcaccaggttgcgggcaatctgcaaacgctgctgcataccgccggaaaaggtggtcggcaggtcgtcgatccggttggcgggaatctccacctcttccagccacttctgcgcggtggcgcgaatgtcgccgtaatgacgcgccccggtcgccatcaaccgctcgccgatattgccgcctgccgagacctgacggcgcaggccgtcgagtggatgctgatgcactacgccccattcggtgcgcagcaggcgacggcggtcggcctcgctcattgcatacagcgaacggttctcgtagtgaatctccccctgctgcggcgtcagacgcgcggagatcgacttcagcagcgtggtcttcccggagccggattctccgacaatgcccagcacttctcccggccataaatcaaaagagacatcgctaaagcctttgcccggcgcgtaaaggtgggtcaggttattgactgaaagtaacggtttattcattggcttttcgcctcgctctgttggcggcaataatcggtatcggagcagacaaacatgcggtttccggcgtcatccagcaccacttcatcaagatagctgtgggtcgatccgcagatggcgcatggctcatcccactgctgaacggtgaacgggtgatcgtcgaaatcgagactttccacgcgggtaaacggcggcaccgcatagatgcgcttctcgcgccctgcgccgaacagctgcagggcgggcatcatgtccattttcgggttatcgaatttcgggatcggcgacgggtccatcacgtagcgcccgttcaccttcaccggataagcataggtggtggcgatatgaccgaagcgggcgatatcttcatacagtttcacctgcatcacgccgtactcctccagcgcgtgcatagtgcgggtctccgtttcgcgcggctcgataaagcgcagcggttccgggattggcacctggaagataatgatctgatcttcggtcagcggcgtttcggggatgcggtgacgcgtctggataagcgtcgcatcgtccgtacgttcagtggtgtttaccccggtcacgcgcttaaagaagttgcgaatcgacacggcgttggtggtgtcatccgcaccctggtcaatcaccttcaacacgtcgctttcgccaatcacgctggcggtgagctgaatgccgccggttccccagccgtagggcatcggcatctcgcgcccgccaaacggcacctgataaccggggatagccaccgcttttaagatggcgcggcggatcatgcgtttggtctgctcgtcgaggtaggcaaagttgtagccgctcagattagccatggttctgctcctgttgcagacgtttgagtagctccagttcggcctggaaatcgacgtagtgcgggagtttgaggtgcgagacaaagcctgcggcttcgacgttgtcggcatgcgccagcacgaactcttcatcctgcgccgggcctgtcgcgtgctcgccgtattccggggtttgcaacgcacggtcaaccagcgccattgccatcgctttgcgctcgctcatgccgaataccagcccgtagccgcgcgtgaagtgcggcggctcatccggcgggtcgataaaaccgttgaccatttcacactcggtcatcagcagttcgccgacgtttaccgcaaatcccagctcttccggcacaatcgatacgtcgatatagccgctgcggatctcgcccgcgaacgggtggttgcgcccgtaaccgcgttgggtggagtaggccagcgccagcaaatagccttcgtcgccgcgcatcaactgctgcaaacgggaagaacgtgagcaggggtaaaccggcggcgtgcgggtgatgtcatccggctgtgcgccgctatcctcttcaaacttcgccagcccctgacgcgccagcaggctgaaaacgtgcggcgacggctgttgttcgctgtcggcggtggtcagcgttggtgcttcaccgtttgccaacagggtgaaatcgagcaggcgatgggtgtagtcgtaggtagggccaagcaactggccgccgggaatgtctttataaaccgccgaaatacgccgttcgagacgcatcccggtggtgtcgagcggctcgcttaccgccagcttcgccaacgtggtgcggtaggcgcgcagcaggaaaatcgcttcaacgttatcgccgctggcctgtttcagcgccagcgccgccagttcgcggtcggcaatgccgccttcggtcatcacgcgatctaccgcgaggttaagctgctgttcaatctgggcgacgctcagttcgggcaaatcggtatcgccccggcgtcggctctcttgcagggcgtgggcggcgtcgatcgccttttcgccccctttcacggcaacgtacatcagcacacctccacatgagtggttcgcggaacagccagcaggcgctcgccgcaggtcaggatcaggtcgatgccgagcgggaacgggtgcgggcgctcggtgagttcgtgcagaatgcactccggcagctgcggagcgatcattcgttcttcggcaatgcccgcgccggtgagacgcaacatgcgtccgccgctcaggctggcgacctgtaaaatcagcgtcgcgcccgcttccggcgcaacggcggtgccggtggaaagggcgttgagctgttcgctggaaatcgcctcatccgtcaccgcgaaggtcgcctgttccggctggctgaccagcggcgcgttggtatgaaaacgcaggctctgattgacgatatcgttacttaatggcgtggcaagccacaccggcgtgtcgttatcggccagcgtcagcagcacgctggtggtggcgatattcagcggctgccagccgcgtttgagctgatgcagggcgacaatcacgcccggctcgctcatcgcctttaacaggcgacgaaaactgtgctgggcatcctgcacgggaagcataaaagcggtttccagggtcatgcgttgtctccgcgaaccatcgtaaagaagtcgacccggctggcgttcacttcggcctggcgtgcggcaatgcgtgccatacggtcagcgtccagcggggcaataagggtttctgataagttttgaaaatggcgggtttgctgcatcagcgcgtcaatcagcgcgcagcgttcggcgtgctgtttgtcgcgccccagcacccagctgtagccgagggtgccgtcagccaggcggacggcggcgcgggtcagcgtggcgtcgccggcaaaaaagcgttcgccggtaccgcccattcgcgcctgaatctgcaccaggccagtttcggccgagcggatcacttcatagtcggcggtgatgttcagcgcgttcaggcgggctgccagttcagccggttggctgtgcgccagcacggacatccagtgctggcgggtcgcggtatctgcgtgcattcagtgctccatagtgaattcaatcatgtcggcgcgggtcaggctgacggagtactccgccgggctgctttcaccgtcacggtggttaagggtgcgcacgcacagcagcggcgacatattcgggatttcaaggcgctggcactctttggcctgggcgcgacgggcgctgatccgcgtctggctgcggcgcagcgcaattccggtttgctcgcgcagaaaatcgtgcagcgagccgctgtcgaagcgttgcagcgtcggccagagggtgaggtccgcgaagtagtggtcgattaaacagagcgcgatgccgttgacgcgacgcagggtgcgcaaatggataacgttctcgccctcggtaatccccagcgcgtcagcaacgtgaccggacgcggggcgtagcaccgacagcagtttttcgctggtggggtggctgccctgatccagcagattctggctaaaacgcgcctgggcgttgagcgggtaatcgaacgggcgcatcagcaccagcacgccgacgccctgacggcgctgtacccagcctttctccaccagttggtcgatggcgcggcgcagggtgtggcggttcaccgcaaagcgcgccgccagctgctgctcggcgggaagatagtcgccgcagctgtagtgttgacgaagctcctgctcaagttttgcggctatctcctgatagcgtgttgggtagctggtcggatgtgtagacaagtgcatagctatcaatgcctcgctaatcagataaagtgcttacgcaaccgttgagagaggaaatccagcaggctgaccgtgacgatgataagcaccatcagggcgcaggtttgctggaactggaaaccgcgaatcgcttcccacagcgtgacgccgatcccgcccgcgccgaccatgccgacgacggtcgccgagcggacgttggattcgaagcgatagagggagtaggagatcagcagcggcatcacctgtggcagcacgccgtagaggatctcttccagcttgttggcgccggtggcgcgaatgccttccaccgggccgggttcaatcgcttccaccgcttcggaaagcagtttcgagagcacgccggtggtgtggataaacagcgccagcacgccagcgaacgggccgaggccgacggcgaccacgaacagcatggcgaagaccatttcgttaatggcgcggcaggcgtccatcaggcggcgaacgggctggtaaacccaccacggcaccaggttttcggcgctcatcaggccgaaggggatggagagaaccaccgccagcgcggtgccccagacggcgatttgcagcgtgacggccatttcggtgaggtaatcctgccactggctgaaatcgggcgggaagaagtcggcagcgaaggttgccatgttgccgccgtctttaatcagcgtaagcggggccatttccgcgccctgccacgagacgaccagcacggcgagaacaacggcccagctcagaagcgagaaccagctacgcttggatggggcgatggtgatggtttgcatgtttggctccgtttaatgttttctccctctccctcaagggagaggggaccgatcgagcacattactgcaccgctttactcaccgaactcatcgcgcttaacgcgttgttcaggcggtccaggtcatccagctgcgcctgaatctcggtggttttcgccagcttgtcctgctcattcagtcctttattgctttttacgccctgcatctctttaaacagtgcgagctggcgaatcggcaccagttgcaggtcgctggaggcgcggaacggggcccagcccaggcgttccagcaccgctttctcttccggcgtttttccgtagttcataaagaagtcgtagatcttgtctttggtggtttcggagagattcttgcgccagacgatcggatcgcctgggatcagcggcgacttccagatcaccttcagttctttcagcttctctggcgcggaggttttcagcttgtcgaggttttcggtgttgttggtggcaacatccacctgcttgttggcgacggccagcgcgttggtttcatgcccagcgttgacggtgcgcttaaagtcgctggcggagatattgtttttggcaaagacgtagtaaccggggacgaggaagccagaggtggagttaggatcgccattgccgaaggtgagatctttccgcttcgccagcagatcgttcaggttgttgatcggactatctttgttgacgatcaacacgctccagtaacctggcgatccatccgccgcgaccgtctgggcgaagacttggccgttggcgcgatccaccgcttccattgccgacaggttgccgtaccaggcgatatccactttattgaagcgcattccctggataatgcctgcgtagtctggggcaaagaaggcgttcaccttcacgcccagcttcttctccatatcctgtaagaatggcgtccattgcggtttaaggttttgctgtgattccgttgaaataatgccgaaattcagcgccttttcctgctcttcggcgtgtgccgggcttaacagggtgctgaggctgaacatgctggtgaaggccagcgaggcaattatcttagcgttcattcgttttcctcaatgatggggatgtcaggcagctttcgcgttctcttcgatgcgattaatgctgcggtagagatggtcaaaacgttcgttatcaaactgttggctgctgccgtcgtagaaaacgtgcccctggcgcagggcgacgatgcgttcgcagtagcgcagggcgtaatccacctgatgcagcgtgacgaccacggtgatgccgtcgttctgattgatgtcgcgcagggtgtccatcacgatgcgggcggattccgggtccagcgaggcgatgggttcatcggccagaatcaccttcgcctgctgcatcagcgcgcgggcaatcgccacacgctgctgctgtccgccggagagggtggaaacgcgctgatgggcaaaatgcaccatgccaacgcgggtcagcgcctgtaacgcgcgctgtttctgctcgccggtgaaccagctaaaacaggtgcgccagaacggcgtgctgccgagcgcgccaatcagcacgttctccagtacgctcaggcggttcaccaggttgaattgttggaagatgtagccggtgttggcgcggcttttgcggatatcgcgtgccagacggccttcgcgctggactgtgcggcccagcagctcgatatggctgccggcggatttatcgccggtaatcaaaccgcttaagtgacgtaaaagggtggatttgccggaacccgacggcccaagcagagccaccatttcaccgtgatgaatgttcagatcaaccgcatgcagcgcctgatgctgattgaaggttttggcgagcttctcgacacggataatcgtttgcatgatgcagcctccctaaaaaagtggctccatcgtggcggattattgtgacgatttggttaattaaaagtgactaacagatgaagagttaacgggaattcgatgacagtgcgggagggcgggcctcccggcggattattgcgttggttgttgtttgacgacattaatcatccacggtacgccaaatttatcggtgactttgccaaagccatgcgcccagaaagtttcctgccaggccatttcgatttttccgttagcggcaagattgtcaaaccagcgttttccttcttcgacctgttgcgaatcgagcaccagcgtaaagccggagtagctggcttttcctgacggcatggcatcgctcatcatgatgtcgcttccggcaatgcgcacgttggcatgagcgatggcggtatcgggaaattgcattccggaagggcagttctcggcgctgtcctgcgctgattttggcatttcgccgaagctgattttatagagcagttcagcgcccaacgtacgttgataataagcaattgcgtcggcacagttaccggcaaaagagaggtagggacttaacggcatgatggtgacctcagttaagagaagccagttaagtgtagttcgaaatttatacagatgagagggaagcctgataagacgcggtcagcgtcgcatcaggcagtcggcatcgttgccggatgcggcgcgagcgccttatccggcttaccgatcacaatacaatcagttctttttcacaaactcagatttcagtttcatcggaccaaaaccgtcgattttgcaatcgatgttatggtcgccttcaaccaggcggatgtttttcactttggtgccaattttcagcatcgaagagctacctttcaccttcagatctttaatgatggtaacgctgtcgccgtcagccagcagattgccgttagcatctttaacgatcagctcgtcgctttcctgtgcaggttctgcgtcgttccattcgtaggcacattccgggcagatgtacatgccgttatcttcgtaagtgtattcggagttgcattttgggcagtgtggtaatgacatgtggatttcctcaaaagtcagcagggcaaaagcgccaaaaaacggcagattgccgaaaaaggccgcaattatacacaaaatccctgagtttgtcgggggtactgctgattttagacgacgatcgttttcatttgaaaggaaacgcaaaaagaaaataatctttttgcctctatttattatttaagataatgttaatgctctacttgttcttttttttattcacatgatatttttatctttctgacgttttaaacgtatcagaagacgttatttattctgataaaaaacaacacactaaatataaaattatttcttgcagtaattataaaagccgaaaacagaactcaaaaacaatctggctaaataaaagtaacaaaatttgctttaaggaagaattttctatgtacacacagaccctgtatgagttaagtcaggaggctgaacgcctgttacagctttctcgccaacagttgcagttactggaaaaaatgcctctctctgtacccggagacgacgcgccacaactggctttaccctggagtcagcctaatatcgccgaacgtcacgcgatgctgaataatgagttgcgtaaaatttcccgactggaaatggtgctggcaattgtcggtaccatgaaagcagggaaatcaaccaccattaatgccattgttggtacggaggttctgcctaatcgtaatcgcccaatgactgcgctgccgacgcttattcgccatacgcccgggcaaaaggaaccggtactgcatttttcacatgtcgcgccaatcgattgtttaattcaacaattacaacagcgcctgcgtgattgcgatattaagcatctgaccgatgtgctggaaatagataaagatatgcgtgcgcttatgcagcggatcgaaaatggcgtcgctttcgaaaaatattatctgggtgcccagcctatttttcattgtctgaaaagtttgaatgatttagtgcgactggcgaaggcgctggacgtcgattttcctttttctgcttacgccgccattgagcatattcccgtgattgaagtggagtttgtccatctggcggggctggagagttatcccggtcagttgacgttactggatacccccgggccaaatgaagccgggcaaccgcatctgcaaaaaatgcttaaccagcagctggcacgcgcctcggcggtactggcggtgctggattatacgcaactgaaatcgatctccgatgaagaggtccgtgaggcgattttggcggtggggcaatcggtgccgctgtatgtgctggtcaataagttcgatcaacaggatcgtaacagtgacgacgccgaccaggtgcgggcactgatttccgggacgctgatgaaaggctgtattacgccacagcagatatttccggtgtcgtcgatgtggggctacctggcgaatcgagcgcgccatgagttagccaacaacggtaagttaccagcgccagagcaacaacgctgggtggaagattttgcccatgctgcgctcggcaggcgctggcgtcatgacgatctggcggacctcgaacatattcgtcatgctgccgatcagttgtgggaagattcgctgttcgcccagccaattcaggcgttgcttcatgccgcttacgctaacgcctcgttgtatgctctgcgatctgctgcgcataaactgttgaattacgcgcagcaggcgcggggatacctggattttcgtgcgcacgggttaaacgtcgcttgtgaacaattgcggcaaaatatccatcaggtcgaagaaagtttgcagctattgcaactcaatcaggcgcaggtgagcggcgaggttaaacatgaaatcgagctggccctgacctccgccaaccactttctgcgtcaacagcaagatgcgctgaatgcgcagttagccgccttgtttcaggatgattcggagccgttaagcgagattcgtacctgctgtgagacactgttacagacggcgcagaacaccatcagtcgcgactttacgctgcgttttgccgagcttgaatccaccctttgccgggtgttaaccgatgttattcggcccattgagcaacaagtcaaaatggaattgagcgagtcagggtttcgtcctgggtttcattttcctgtttttcacggcgtagttccccacttcaacactcgccagctgttcagtgaagtcatttcgcgccaggatgcaacggacgagcagagcacgcgtttaggcgttgtgcgtgagactttttcgcgctggttgaatcagcccgactggggacggggaaatgagaaatccccgacagaaacggttgattacagtgtgttgcaacgagctttaagcgcagaagtcgatctttattgccaacaaatggctaaagttctggcagagcaggtcgatgaatctgttacggcaggcatgaatacttttttcgctgagttcgcttcatgtttgacggaattacagacgcgtttacgcgaaagtctggctctgcgtcaacaaaatgaatcggtggtcaggctgatgcagcagcaattgcagcagactgtgatgactcacggctggatttacaccgacgcccagctgttacgcgatgatattcaaacacttttcacggcagaacgatattgaccaagacgttacttgacggccccggtcgcgtgctggagtcggtttatccccgctttttagtggatctggcgcagggcgatgatgcccgccttccacaagcccatcagcagcagtttcgtgaacgactgatgcaggaacttcttgcgcgcgtgcagcttcagacatggacgaacggcggcatgttaaatgcgccgcttagcctgcgactgacaatggtggaaaaactggcgtcgatgctggatcccggtcatctggcgctgacgcagatcgcgcagcatctggcgctgctgcaaaaaatggatcaccgccagcactctgctttcccggagctcccccagcaaattgccgccttgtatgagtggttttcagcccgttgccgctggaaggaaaaggcgttaacgcaacgaggcctactggtgcaggcaggtgatcagagcgagcaaatttttacccgctggcgtgctggggcgtataacacctggtcgttgcctgggcgctgttttatcgttctcgaagagttgcgttggggggcatttggcgatgcctgccgtctgggaagcccgcaagcggtggcgttgttgctgggggatttgcgcgtgaaagcgacacaacatctggcagagagtatcaatgcggccccgaccacgcgtcactattaccatcagtggtttgcctcttcgaccgttccgacgggcggggatcatgctgattttttaagttggctgggaaagtggaccacggcagataaacaacccgtttgctggtcagtgacccaacgctggcaaactgtcgcgctggggatgccacgactctgttcagcgcagcgtttggtgggggcaatggtcgaggaaatcttctctgtaaatttggcgtaaataatcagttacatcaatgagtcctaaacgaaattcatgtgtgaagttgatcacaaatttaaacactggtagggtaaaaaggtcattaactgcccaattcaggcgtcaactggtttgattgtacattccttaaccggagggtgtaagcaaacccgctacgcttgttacagagattgcatcctgcaattcccgctccccttttgcggccgtcgcgctgatttttctggcgtttgcggaaatgggccaactctgcgaggaaagctatgctgaaaaggaaaaaagtaaaaccgattacccttcgtgatgtcaccattattgatgacggtaaactgcgtaaagccattaccgcagcatcactgggtaatgcaatggaatggtttgattttggtgtttatggttttgttgcttacgcattaggtaaagtttttttcccgggggctgaccccagcgtgcagatggttgctgcacttgccacgttctccgttccctttctgattcgaccgcttggcggactcttctttggtatgttgggcgataaatatggtcgccagaagatcctcgctatcactattgtgattatgtcgatcagtacgttctgtattggcttaataccgtcctacgacacgattggtatttgggcaccgattctgctgttgatctgtaagatggcacaaggtttctcggtcggcggtgaatataccggggcgtcgatatttgttgcggaatactcccctgaccgtaaacgtggctttatgggcagctggctggactttggttctattgccgggtttgtgctgggtgctggcgtagtggtgttaatttcgaccattgtcggcgaagcgaacttcctcgactggggctggcgtattccgttctttattgctctgccgttagggattatcgggctttacctgcgccatgcgctggaagaaactccggcgttccagcagcatgtcgataaactggaacagggcgaccgcgaaggtttgcaggatggcccgaaagtctcgtttaaagagattgccaccaaacactggcgcagcctgttgacatgtattggtctggtaattgccaccaacgtgacttactacatgttgctgacctatatgccgagttatttgtcgcataacctgcattactccgaagaccacggggtgctgattattatcgccattatgatcggtatgctgtttgtccagccggtgatgggcttgctgagtgaccgttttggccgtcgtccgtttgtgctacttggtagtgttgccctgtttgtgttggcgatcccggcgtttattctgattaacagtaacgtcatcggcctgatttttgccgggttactgatgctggcggtgatccttaactgctttacgggcgttatggcttctaccttgccagcgatgttcccgacgcatatccgttacagcgcgctggcggcggcatttaatatttcggtgctggttgccggtctgacgccaacactggcggcctggctggtcgaaagctcgcagaatctgatgatgcctgcctattacctgatggtagtggcggtgattggtttaatcaccggcgtaaccatgaaagagacggcaaatcgtccgttgaaaggtgcgacaccggcggcgtcagatatacaggaagcgaaggaaattctcgtcgagcattacgataatatcgagcagaaaatcgataatattgaccacgagattgccgatttgcaggcgaaacgtacccgcctggtgcagcaacatccgcgaattgatgaataagctgaaacggatggcctgatgtgacgctgtcttatcaggccaattgaactcttaaggttcacttaatctctgacgcgcatactctcctccaggttaacggaggagagtgcaatgaaaaaccgtgtttatgaaagtttaactaccgtgttcagcgtgctggtggtcagcagctttctttatatctggtttgccacgttctgatctttcttcagccgtacccaggcccgcgtgccggaagtctcttgccggttttgcaggaaaaactgcccgtgatgcaactgtgtaatgcggctgacaatacttaaccccagaccaatcccgccataacggctgtccatacgtacaaacgctttactcaactccccgcatttactctcatcaatacctggtccttcatcttcaactgccatgaccgctccgccatcttcttgcagcttaatcataatgttgctgccttgcgggctgtaacgatgggcgttttctaccaggtttcgcaataacatccgcagcagggttgcatcaccctgaacggtgatgtcggcggcgctctctggcaatagcagggtttgctgtcgctggtcgagcatggtactgagttcgtcatacgaggggagaatgacatcttccagcagttttacatgttgataattaccggaagaaaatgactgtccggcacgcgccagttgcagcagctgggagacgctctccatcatctgatcaagccgtgccactaacggtgctacatcaatgtgatgcgttttcgccagcagttccagatgcaaacgcaccccagccagtggcgttcgcagttcgtgcgcgacgtcagcggtaaacaacctttcgttatccagcgtgctggtcaggcgactgaccagatcgttcaacgccgaaaccaccgcttcgatttcgagggtggcgctgtgaatggcaatgggcgttaagttgtcggcggtgcgcgcttccagctctttttgcagctccgccagcgggcgagtgatgcggcgtaccgcctgatagcagataaatagcgtcaggctgaccataaagacgccggggacaatcaggctggcgaccgcctcgcggatctcacgcatgatgtggcgatcgttgttgcgattgtcgcgtagcgcctgctcaaacagctgaatctgctcggtactttcatgccatagccagaagacgctgatcagctcaaacaccaacaaaatggccccgatggtcaatatcagccgttggcgcagcgatattggtcggcgcagaaaatgcatcagattcaattagttttcctcattcgcgaccagcatatagccaaagccgcgcacggtgcggatacgggctttgcccactttgtcgcgcagattgtggatatgcacttccagggtgttggtcgagggttcattgtcccagttatagatgtcgttgtagagaatttcccgatgcaccggactgcctgctttgagcattaaccgtgacagcagagcatattctttgggcgtcagaatcaactcttcaccgcccatccatacctgacggcgacccatattcagcgtcagattgccaacaatcagctcactttcgccctgattattatggcgtcgtagcagggctcggatacgggcgtgtaactcttccagcgcaaagggcttcaccagatagtcatcggcaccgacatccagcccggcgattttgtcggtcagcgtatcgcgagcggtgaggatcagtaccggcagggtgtattttttctgccggatacgggcgagaaaatgcagtccatcttcgtcgggtaaccctaaatccagtaccaccaggctgtaatgaccggcctcaaggctttgttccgccatccgcgcggttgtcacgccatcgcacgcgtagccttcagtttgcgccgccagaatcaatccctgcaataacagcgtatcgtcttcaacaatcagaattttcattcactcactctcctgcaagtttgcagaatatcatccgcagcctggtaatacttcgtctcaacgccagttaatcccaatagcgtggagaataaattgtcttgtgaatagtgttgcgtttgcgcctgtttttgcaggcagttctggtcaacctgataccgtttttgataatcctccgacagccacagcagcatcggcacctgtttttggctatccggggcgatggcataaggcagaccgtgcagatagatgccattttcacctaacgattcaccgtggtcagaaagataaaccaggctggtggtaaatttatcctgatgttctttcagcagattaatcgctttatcaacaatatagtcgacgtaaaccagcgtgttgtcgtaagtgttcaccagttgctctttgctacaggtctggatctcattggtgtcgcaggttggggtaaatttcctgaactgcggcggatagcggttgtaataggtcggaccgtggctgccgatggtgtgtaagacaatcacgccatcaccctgcaggttattgatgtactcttccagcccgtggaacagcacttcgtcatagcattcgccgttgatgcactgaccaggcagattcagcgcggtgacgttctggtgaggcacgcggtcgcaggcacctttacagccgccatcgttgtcattccacagcacgttgatgcccgctcgctgaatgatatccagcacgccttcctggtgctgtgccagctcttctttgtaatgctcacgcggcatatccgagaacatgcacggtactgaaactgccgttgccgtgccgcaagatgcggtattagggaaatagaccacgttatctttcgccagccgcgggttagtttcacgcgggtagccgttgagggagaagttctccgcccgcgaggtttcgccgacaatcaggatggtcaaatttttacgtttttcgttctgcattaacgggttgcggtgggcgtcttcaccaattcgcaccagcggtagatttgccagtcgctgatgggagtaccatgaccagctggcaacaatgctgttagaggggcttaaggatttcaccagctctttgttattgcggaacaacgaggcgtagtctttataaaacagtgcggcgaccagcaaaatcagtagtacagaaaccagaatattggctccacggaaaagaacactgcgcagacgcgaggtggcaggtttgatttttatccagcaggcaatcagcgcagcaagcacgccgctgaatcccagcgttaataacatttgcggtgtcatcagcgcataactttctgccggagtggtatcaataatattggcaatcatcgagcggtcgatgacgatgccgtaagtcattatgaaatattgtgcagccgcgccaaccagaataaacaggcaggccagtggtcgattaagccataagaaagagcttagtgtcaggacaatattaatcacgctgaaagcgacgaccggcatcgacaagaaaaccagtacgttatgcagcgaatccagcggcagcgcctgcaacacctgtttaaaaaaggcaatattcaggcagatagagatataaaaagcggccaacaatagccaggcgagtaaattcaaagagggtctttttagtaggcgcttcaacatcacggtgtttccatcgaacaaagtgcgcatatgctcgcaaagcaaaattaagccaaccttaagttcttaaggttggcttttatgtttgctggattaaggggaattaatctttgcttattggtacatctaagggatacgggtttttatgtagccggttgtaattcagcgcatacatggcggtgatgaccatcagggtgacaaatgaccacataacctctttcgctccggaccccaccacggcccagatgcagtagaggaaggcaatggtagtaactgccagatatgccgggcgtgctttaccaaagtgaccgtgtccgagcagcagtaacgccgcacaggtgtaaagatatggcaccagtgtaaagatgaccgagacggaagaaaccagaccgaactctttggtcgcgtttggtgaaatgctgctgagctggaagatggtcatcaaaataccgacgataatcagccccgccactggcgtacccgctttatttacacgggcaaaaattggtgggaacagtccgtcatcggcagcggctttcgccgtttgccccgccagcaacgtccagccgcccagtgaacctaagcaacccgcagctgcgcagaaggaaacaatggccccggcggtgtcacccaacgccatccgtgcggcatcaccgaatggcgaagcagaaacgcgcagtgcggcattagggatcatccccataatcgcggtggtagaaagtacatagcaaacggcggcaatcaataccccaccaatggtggcgatagggacattgcgtttcgggtttttcaccacacctgcggcaacggaggcactttccacaccgatgaacgaccacagcgtaacgttaagggtactttgaattgcaccgaaggtgcccaggccgctgacgttccatgccgccatataggtttcaccacggaaccagaaccagccaaatacggcaatcccgacgatggggatcagcgccagcacggtggcaactgcctgcacacgggtgatcattttcggaccgacaatgttcagcaggacgaagatccacagcaccacgacgcaggtgatggttaataccaatggatctttcagaatcgggaagaagtaacttaaatatcctacgccaatgaccaccatggcgatattgccgatccagcaggccagccagtagaggacgttggtttgataaccgagaaacgggccaaagcagcggcgggcgtaagcgtaagaaccaccaggacttgggtcgaggaacgacattttggcgtataccatcgagagccccagtgcaccgataatcgtcaccaaccatccataaatggcaatcccgccagtagaggccaggtttgcaggtaacagaaaaacacctgaccccataatattccccgacaccatcagggtgacggggattaagcccactttgtgagcatcagcatccgaagacataattaaactcctgcgaaggcgagcttcgtgacaataaattacgtcatatcatacgcctgcattcgatagttgaattattatcgaccgggttatcgctgatgccgttattaatatagctcttcgttaaggttaaaaatcaggcgacagtgcgttctctgtgctgactaacataatgcagcggcgtcataccgtagaagtctttaaagacagaaataaagtacgacgtactgttgtagccgcaggactgtgatacctgagagatatttttaccgtccatcattaattcatttacggcataacgcatgcggcaggtggtgattatttggctataactggtgttttcgcttttcagctttttctttaacagacttgggctaagacataaacaactggctaccatactaagattccagtctttgtgaatatcgctttcaataatttgataaacgctgtcacttacacaattacgtaacatatacatcattaatgaaaggaattttttactgtcgagaaaacgggatagcaccgtgaataataatgcgcgtgttcgttccttttctgactcagtttctgcgggcatcatgctgtgttgcgcggcaacgcgaaagacgtctggcgtcaggcatggcagggtgagtatgggcgtagcgctacgttgccatactggtatttgcgagagatctttattcagaaaccggaggtaatctttgatgatgtcgtgactaatatgagcaaccaaagtgttgttaagagaggagacgtcgataatattattttcacaatttaataacgccatatggttagctttaaggctaataggttctttcccattcacccttatccagacatctttttcagtcaataaaacaatacaaggttggtcgctgcaaatcctcatacatgtactcctgagtgcgaataaaagaccagttctcgctaaagcaaagcgataccgggaaatggttatataattgtatgatgaatataaacatgcataaaaataacgagttttactaatattacaaatttttatagtaatttctcatgtacatatttttttacaggataaataacaggcaaaaaaaagcgcggggtggggccgcgcaaaaagtatgacatttttgtttgcagcaatttttatgaaaacgttgccatactcaaaaggcctaaggccaggcggcgtaatgttatttaaacaattacgccttcagcggaatagtggttacgctttcacacacataacgtggtaaataccgtcaataatttcagtcccttcagtttcgtgttcaaatccagggaaatggtggtcccaggattgcagcgagcgtaaataacttacttgcggactgtttttatcgccgaagttttcaccagacagcagcatcgggattcctggcggatatgggataactgagtttgccgcgatgcgtcctggcagattttcaatggataccagttcgacattgttgtcgacaatcgcgttgtacgcttcacgcggggtgatttccgccatcggcaggccggaataggcttcgttcaaccgtgcgccagggttgttttctttcagccaggcaaacatggtgtcacccagatcgtgaatccccatgttcgcgtaagtgtcaggatattgttcaacaagttccggcatcacctgcgccagcggtgtgttggcgtcatagtggcgtttgaaggagcaaagggtgttaaccagagtcccccatttcccacgggttacgcccatagagaacaggaacataatttggaagtcagtggtgcgggtaggcacaatgccgtggcgaccaagccaggcagtgaccagcgccgccggaacaccggtttcttccagttcaccatcttcacccattcccggagcaaggatgctgactttaattgggtcgagcatactccagttatccggaatatctttgaagccgtgccagctttcgcccggatgcattacccagcagtcctgaacggtggtcagcagtttggttggtgcgtcagcaaagtcataggttttgccggtttgtgggtcggtgacgacttctttgttccacggtttgaagaaccagctaccgtcagcggtgaactctttatatagccgcgccatcgcctgacggaaatcaaccgcttcgtcaatcacttcctgtgtcagtgacaggccgctgttgccgtccatcatcgacaccgccacgtcgttggatgcgcagatggcatacagcggggaggtggtggcatgcatcatgtaggcctggttgaagcgggagaagttaatcgccccacgaccttcacgtacatgaatataagaagcctgtgacagcgcattcagcagtttgtgggtggagtgggtggcgaaaacggtaggaccgttgtgatcgccaggttcgccgcgcatggcatagtgatcggcatagatcgggttgaaacgtgcatagccgtaccaggcttcgtcaaagtgcagacgatcggaggttttttccagcagatcctgcgcttctttagcgttataacacacgccgtcataggtgcagttggtcaccacgcagtaagacggtttttgcccggctttgtctttggtcagcgggctttcactgattttcttctgcaaggtttcaggttgcatttcctgcggatagattggcccgataatgccgtagcggttgcggcttggcaccatatagaccggtttcgcgcctgtcagcatcaaaccttgttcgatggatttatggcagttacggtcaacgaccacgacatcgttatcggtcatgcaagcctgcatgatggtgcggttagagccggaagtaccgacgactaccgaccaggagcgatcggcaccaaatacgcgtgcggcatatttttcgctttcgccaaatgcgccagtatggtcaagcaaagaaccgagggaagttcgttcgatgcccatgtcggtgcggaacagattttcaccatagtagtcatggtagaaacgtccggcgggtgttttggtaaaaccaacgccgccctggtggcctggcgctgcccaggaatattcatggatgtcactatatttcatcagcgcgctgaacagtggcggcaacagctgctggcggtagcgggtcatcgcggcaacggcgcgtccggcgataaagtcggcggtatcttccagaatccaggcgaattcatcgacaagctccagcagatcccggtccattgcggcgagggctttttcccgatcgcccaacaggaagaccggcacgttttgttggcgctcatgaagcttaccgatcaattgtctgacgttttgatgttcgtccggatgttccatttgatagctgaacatcaggcagtcaatggcttcgtttgaagagagaatggcaaaaccatcatcaaaggaggtggatttaatcacggtaacattttgctggcttaaagcatctgccagacgctcaacggcgttaccgacccaggtgtcttgatggagaaactcgctttcaacaattaatactttcatcattgcttacccggttatgaaggaatcttcgttgcgggcaagtatcttccggccttttcgggctgtaaagcgcgtgaaaaacaaacatttttggaatatttatttttataaacaatatgttatgtgattattttaatttattttcactgcttattatcgacggctaaactatttttttggctgatactgatatcgtctttagccgggaaacgtctggcggcgctgttggctaagtttgcggtattgttgcggcgacatgccgacatatttgccgaacgtgctgtaaaaacgactacttgaacgaaagcctgccgtcagggcaatatcgagaatacttttatcggtatcgctcagtaacgcgcgaacgtggttgatgcgcatcgcggtaatgtactgtttcatcgtcaattgcatgacccgctggaatatccccattgcatagttggcgttaagtttgacgtgctcagccacatcgttgatggtcagcgcctgatcatagttttcggcaataaagcccagcatctggctaacataaaattgcgcatggcgcgagacgctgtttttgtgtgtgcgcgaggttttattgaccagaatcggttcccagccagagaggctaaatcgcttgagcatcaggccaatttcatcaatggcgagctggcgaatttgctcgttcggactgtttaattcctgctgccagcggcgcacttcaaacgggctaagttgctgtgtggccagtgatttgatcaccatgccgtgagtgacgtggttaatcaggtctttatccagcggccaggagagaaacagatgcatcggcagattaaaaatcgccatgctctgacaggttccggtatctgttagttggtgcggtgtacaggcccagaacagcgtgatatgaccctgattgatattcactttttcattgttgatcaggtattccacatcgccatcgaaaggcacattcacttcgacctgaccatgccagtggctggtgggcatgatatgcggtgcgcgaaactcaatctccatccgctggtattccgaatacagcgacagcgggctgcgggtctgtttttcgtcgctgctgcacataaacgtatctgtattcatggatggctctctttcctggaatatcagaattatggcaggagtgagggaggatgactgcgagtgggagcacggttttcaccctcttcccagagaggcgaggggagcgtccgagcatcatgaggccgaaaactctgcttttcaggtaacttattaccataaactcagatttactgctgcttcacgcaggatctgagtttatgggaatgctcaacctggaagccggaggttttctgcagattcgcctgccatgatgaagttattcaagcaagccaggagatctgcatgatgactgcacccaaaattacatttatcggcgctggttcgacgattttcgttaaaaatattcttggtgatgtgttccatcgcgaggcgctgaaaacggcgcatattgccctgatggacattgatcccacccgcctggaagagtcgcatattgtggtgcgtaagctgatggattcagcaggggccagcggcaaaatcacctgccacacccaacagaaagaagccttagaggatgccgattttgtcgtggtggcatttcagattggcggttatgaaccttgcacggtgactgatttcgaggtctgtaagcggcatggtctggaacaaaccattgccgatacgttggggccgggcggtattatgcgcgcgctacgtaccattccgcatctgtggcaaatttgcgaggacatgacggaagtctgccccgatgccaccatgctcaactatgttaacccaatggcgatgaatacctgggcgatgtatgcccgctatccgcatatcaaacaggtcgggctgtgccattcggtgcagggaacggcggaagagctggcgcgtgacctcaatatcgacccagctacgctgcgttaccgttgcgcaggtatcaaccatatggcgttttacctggagctggagcgcaaaaccgccgacggcagttatgtgaatctctacccggaactgctggcggcttatgaagcagggcaggcaccgaagccgaatattcatggcaatactcgctgccagaatattgtgcgctacgaaatgttcaaaaagctgggctacttcgtcacggaatcgtcagaacattttgctgagtacacaccgtggtttattaagccaggtcgtgaggatttgattgagcgttataaagtaccgctggatgagtacccgaaacgctgcgtcgagcagctggcgaactggcataaagagctggaggagtataaaaacgcctcccggattgatattaaaccgtcacgggaatatgccagcacaatcatgaacgctatctggactggcgagccgagtgtgatttacggcaacgtccgtaacgatggtttgattgataacctgccacaaggatgttgcgtggaagtagcctgtctggttgatgctaatggcattcagccgaccaaagtcggtacgctaccttcgcatctggccgccctgatgcaaaccaacatcaacgtacagacgctgctgaccgaagctattcttacggaaaatcgcgaccgtgtttaccacgccgcgatgatggacccgcatactgctgccgtgctgggcattgatgaaatatatgctcttgttgacgacctgattgccgcccacggcgactggctgccaggctggttgcaccgttaaaacgcgactaaacgctactgcgccgggggatttattccggcgcacacctctgacgataccaataacagaaggcgggcgttggtaacagcgacccgataccctatgagcatttcaatgactacaaaactcagttatggatttggagcgttcgggaaggattttgcgatcggcattgtgtatatgtacctcatgtattactacaccgatgtcgtcgggctgtctgtgggtttggtcggtactttgtttctggtggcgaggatctgggatgctattaacgatccgattatgggatggattgtaaatgctacgcgatcgcgatggggtaagttcaaaccctggatcctgatcggtacgttggcaaactctgtaatcttatttctcctctttagtgcgcatctgtttgaaggtactactcagattgtctttgtttgcgtgacctacatcctctggggcatgacttacaccattatggatattcccttctggtcgctggttccaaccatcacgctcgataaacgtgagcgcgaacaactggttccttatccgcgtttttttgccagtctggcaggctttgttacggcaggtgtgacgctaccatttgttaattatgtcggcggtggcgatcggggatttggctttcagatgttcactctggtactgatcgccttttttattgtttcaaccatcatcactctgcgcaatgtgcatgaagtcttttcgtcagacaatcaaccgtctgctgaaggaagccatctgacacttaaagccatcgttgcgctaatttataaaaacgatcagctttcatgcctcttgggtatggctcttgcttataatgtagccagcaacattattaccggatttgctatctattatttctcatatgttatcggtgatgcggatttgttcccctattatctgtcgtatgcgggagctgctaacctggtgacgttagtattcttcccacgcttagttaaatcattatcccgacgcattttatgggccggagcatctattcttccggtgttaagctgtggtgttctcctgttaatggcattaatgagctatcacaacgtcgtcctcattgtgattgcgggtattttgctgaatgtgggaacggcgcttttctgggtattacaggtcatcatggtggcagataccgttgattacggtgaatataaactgcacgtacgctgtgaaagtatcgcttactccgtgcagactatggtggtgaagggcggttcagcctttgcggcttttttcattgcggttgtgttagggatgattggctatgtaccgaatgttgaacagtctacgcaagccctattaggtatgcagtttattatgattgctctaccaactctgtttttcatggtaacgctgattctctacttccgtttctatcgcctcaatggcgacacgctgcgcaggatccagattcatctgctggataaatatcgcaaagtaccgcccgagcctgttcatgctgatattccggtcggtgcagtgagtgatgtgaaagcctgacgtggacaatagctaacgaaaatggcctgatgcgatatgtttatcaggccacgtcttaatgtaatgctttggatttgcaaattttgtagaccggataaggaattcacgccgcatccggcatcaacaaagcgcaagttgttatccggttatcaagccaaagcgccgtagctggcggcaatgaaagcgagcgaggaatatcaccgtcgttaatgcgccaagcagcgcgcagaacatatcggattgcgtgtcccactggtcgccctgggtgccgagaaaatcatccgctccctgacccattgccagcgctgcccaccactcgattaattcatacatcgcgcttatcgccagcgccacgcagcagaccaggaacgccaccattttacgtccgcgcacgtacatcccgcgaacgagaatttctcgtgccaccagtgcaggtaccagcccctggaaaaagtgccccagcttgtcatacggattacgactcaaccccagccattcctgcacctcaaaaccaacggggactttcgcgtaggtgtattgcccgccgaccatcaggatgatggcgtgaaagaaaatgagcgtatagagcagcggcgttaacggataacgtctggcggtggcaagcagtagcggcacgacaataatcaccggtgtcacttccatcagccaggtgagtttgtcatgggccgaaatgccggtataaatcaggattaatgttagcgccagtgcgccggtgttaagaattaacggcttgagtgtgcgggtcatggtgagttcgcaagtcagggaaaatactgactattcaccagcaagcgtgaaattacaatcgcaaaagaggtggcccagggggatcacctggcagcatgctgccaggcgctgggccgaagaggttacttagtgcagttcgcgcactgtttgttgacgatttgctggaagaagtcgttacctttgtcatcgaccaggataaacgccgggaaatcttctacttcgattttccagatagcttccatacccagctccggataagcgacgcattccagatgcttgatgctctgctgcgccagtaccgccgccggaccgccgatgctaccgaggtagaagccgccgtgtttatgacacgcgtcggtaacctgctgactgcggttacctttcgccagcatgatcatgctgccgccgtgggattgcagcagatccacgtaggagtccatacggcctgcggtggttgggccaagtgaacctgatggataaccggcaggggttttcgccggacccgcgtagtagatcgggtgatctttgatgtactgcggaagttctttaccggcgtcaatcagctctttcagcttggcgtgtgcaatatctcggcccacgataatggtgccggtgagcgacaaacgagtggataccgggtattgcgaaagctgggcgaggatctctttcatcgggcggttaaggtcaactttcaccgcttcgccttcaccggcctggcgcagttcttgtggaatgtactggcctgggttgtgttccagtttttcgatccagataccttcgcggttgattttcgctttaatgttacggtcagcggagcaggagacgcccatgccgaccgggcaggatgcgccgtgacgtggcagacggataacgcgaatgtcgtgcgcgaagtatttaccgccaaactgcgcgccaagaccgagtttctgggcctcttccagcagttcctgttccagctggacatcgcggaacgcctgaccatgttcgttcccttccgtcggcagttcatcgtaatagtgagcgcttgctaacttgacggttttcaggttggtttccgcagacgtaccgccaatcacaaacgcgatatggtacggcgggcaggctgcagtaccgagggtacgcattttctcgacgaggaagtttttcagtttgccgggagtcagcagggctttggtttcctggtagagatacgttttgttggcagagccgccgcctttcgcaacgcaaaggaatttgtactcatcgccatctaccgcgtacaggtcgatttgcgcaggcaggttagtgccggtgttgacctctttgtacatgtccagcgccgcattctgtgaatagcgcaggttatcttcgatataggtgttatagacgcctttcgacagcgcttcttcatcaccgccgccggtccacacgcgctggccttttttaccgacgatgatcgcggtgccggtatcctggcaggtcggcagcacgcctttggcggcgatttcggagtttcttaagaattgcagcgccacgtacttgtcgttttcgctggcttctggatcgtgaagaatagccgcaacctgtttctggtgtgccgggcggagcataaaagaagcgtcgtgaaaggcttgctgcgccagcagggtcagggcttctggttccactttcaggatggtttcgccgtcgaagtcggcaacgctaacgtaatcggaagtgagtagatagtattcggtattgtctttccccatcgggaaaggtgcctggtagataaagggtttgtttgacatagcttccagcctgtaactctgtatttgttattcgaaaatggcgtgccgcgtagtcacgggcggcacgcaaagtgcatttataagaacccgtacatcgcggcgaagatccagccgaagacgcacgatacgctcacaccaatcaaccccggcagaataaagctgtggttgatgacgaagcgaccgatgtgggtggtgccggaacggtcaaactgaatcgctgccagatcgctcggataagtcggcaggatgtaataaccgtagcaagccggtgctgaagccacgatgtatgccggatcaacgccgatcgccagcgcgaccggaacaatcgccgccagcgccgcagcctgagagtttacaaacttggaaaccagcagcagaacaatggcataggcccacggatactctttcaccatttcacccagtacgccctgaatttcagacatatgcgcaccgaacatggtttctgccatccatgcgataccgtacaccgccacgatggcgatcataccggaacggaagacttcgttttttgagatagacgcgggattggttttggtcaggataataatcagcgccccggtcagcagcataaacatctgaataaccagtaccatcgacagcggtttgccgccgaaggatggacgcaggtccgaatcagcaccaagaagggcgactacagcgattgcaccgaggaaaatccacattgccagccagttgcttttcggcagttttttatcgagcagcgtcgcggtatcaccgtaaacatactcacggttttccggtacggagatgaatttctggaactcttcgtctttatccagatctttaccgcggaaccagctgaagataccgatcgccaggataccgattaacgtcgatggaatggtgattgccagcaggtcgaggaactcaagatggcgaccatcaaaggtgacattacccagcattgcaaccagagacacgaccgcaaccgacaccggactggcgataatccccatctgtgcaccgatagaacttgccgccatcggacgttccggacggatgttgttcttaatggcgacgtcgtagatgatcggcagaatggtgtaaaccacatgacccgtaccgcaaagaatggtcagtgtacaggtcacaaacggcgcgacaattgagacatatttcgggttgcggcgcagcaacttctcggcaatttgcagcatgacatcaagaccgcccgaagcttgcaaggtcgccgatgccgccaccaccgcaatgataaccagcatgacatcaactggtggtttacctggctgaaggtggaagacgaagaccagaatgaccagaccgataccgcctaataaacccagcgcgataccaccctttctggcaccataaaacagacatatcagtattatgataagttggatagtaaataacatgtgtgaaccctcgcgataatcctatttaaatttttgctgaatagatcacagtcacgttctgttttgtatgaactgttttcagagcctgactaaatatccgtttggtcgttaccggctttagcaaatacctcacagtaaatattggctgattaaagcagcggcaaatttatgcactgtgataagcggctttttcagagagaaaaactctctggcgatgggtttatagtttgtactgcgcagatgttaatgttttgtttgctgttatcttattgatatttatcggtctattttttgttctcagggcagatatcattaggtttaaagattaatctgatctacccatttgtgggtaaaaatacacataatgcgggtgacataatagttaattaacttttgttagcgttttgaaattaaaaacaccgttcacctgaagagatattaatttttagcgatgatggagggataattatatttgatctggcacaagttttactgatgaaggatgtaacttgtgccaggggtattttgcattacggtaataattattacttacagataaccagcgatccgttattggcaatattgtttcagcagtgagtagtgttctgcctgaatacggtaacggtaaaccggacgccccgtgacgccataatggatactggtgaacaagatgtggcagttgaccagccagatgaggtattttcggcaggaaacacgcgagatgttaacctcgttagccagctcgtcggttgaaaactcatagtcctgatgcgcgtcaatccactggcacagcgtgcgtaacgtctgcggcgttaagccttttggcaagcgacgaggatcctgttcgttggagctgctgccgtggattagctgatcaagctcggcctggtcataatactgatgtttttccagcgccattttcttttgccgccagccggtgagcgcctcttcaaagcgggaagcctggaagggtttgatcaggtaatccacgacaccgtaatgcagcgaatctttaatggttgccgcatcggctgcggaggagatgacaatcacatcacttttgcaacgcgcgttatgcaggacaggcagtaaatcgagcccgttctctttttgcatatagatatcgagcaatatcaggtcgataggcgtatcgctattgaagataatctctttggctttctccagcgtcgaggctgttccacagcattgaaagcctgggatttgtgctacgtatcggcgattcagctccgcgaccattgcgtcgtcatcgataattaatacattgatcatctgttcgacctctccccgtcccagggtatctggacaaaaaattgtgtgaaaatcccgggttccgattccacggcgatgctgccgccgagattttctacctgttgtttgacaagtgctaaaccgacgcctcgctcgcttccttttgtcgagacacctttgtcaaaaatgtgatcgattttgtcgggtgcgatccccggtccatcatcgttaacttcgcagtgcagccagccgtgacggtagtgcaatgttacgctaatttcgccaccgggttccggccctaatgcttccagcgcgttttctatcagatttcccaatgtggtaatcagcgtcgcgacctggtcctcactgccgctgtctggcagcaggctttcactgtttaaaatcagcgtatggcctaaatcggtcgcgcggttaatcttgctgattaaaaaaccagcgataaccggagatttgatcttacccagcagagagccaatctcttcctgatagttattggctgttttgagaatgtaatcttccaactgcttataactcttcagatgcaataatccgagaatcacatgcaatttattcataaattcgtgggatcgttcacgaagtgcatcagcatagttgaccagaccgtcgagtcgctgcatcagtttacgaacttcagttttgtccctgaaggttgaaatggcaccgatgataacgccattactgcgcaccggaacggtgttgatcagtaatagccggtctttaatcgtaatctcttcgtcgcggcgcggcgtaccgtcgcgtaacacttccgagacatctaccacctgtgaccatgagtggcttagcgtcgacagtttctcatcgtcctgcgacttacggtaattcagcaattcttgtgcggcatcgttgatcagcgtgacctcgccgcgatcgtccacggcaacgacgccttctttgatagactgcaacatggcctggcgctgctcaaacagcgtggagatttcgtagggttccaggccgaaaaggatttttttcagtaccttaaccagaatgcaggtgccaatcagtccgaccagcatgccaaataataccgaccagataatgctccagcgactgtcattgatttgttgggtcacgcggcttaactcaaggccgatcgccaccacgccaatttgtttatgattttcatcgtagatgggggtaaatacgcgtaaagcctgcgccagaaaaccgcgattgatagcgacattttctttgccattcagcgctttaaggatgtcatcacctttaaatggctgaccaatacgctgggcttcaggatgcgagtagcgaagactttgcatatcggtaacgacaataaacagcagatcgttgcgtttgcgcacggcttccgcgatggcctggattccgctctcctgcggttttttctgcaagccctgacggatttccggcgagtcggcgagggtacgcgccactgccagtgccttgttggccagcccgtctcgcgtcatatcactgatttgcgagaagtaaatcagatgcaccaccaatagcaccgagaacagtaccgcgctgaccattaagatcactgtggtactcaatttcatcggacgtttgcgtaacatgcggtagggcaatgaatgtctcatcagcttccttgtgtgacaaatttcttaagcattatctctgatgaggcgggtaattcaaagggagtaagaatgattggctatataggggaagagactctggcaacggaaactgccagtgctgtatgaagattccagggctatgcttatagcgataatcatactgatgagagagggaaagtcatggatcaggcgctactggacgagggttatcgctgttataccggcgaaaagatcgatgtctatttcaacactgcgatatgtcagcattctggcaattgcgtacgtggcaacggcaagttatttaatctcaaacgaaagccgtggatcatgccggatgaagtcgacgttgccactgtggtgaaagtgattgatacgtgcccgagtggtgcgctgaaataccgtcataaataagcgagggtaaaatggaaatacgcgaaggccacaataaattttacattaatgacgaacaaggcaagcaaatcgctgaaattgtctttgtgccgaccggagagaatttagcgattatcgaacataccgatgtcgatgaaagcctgaaagggcaagggattggtaaacagctggttgcgaaagtcgtggaaaaaatgcgtcgggaaaaacgaaaaattatcccattatgtccatttgcgaaacacgaatttgataaaacgcgggagtatgatgatattcgcagttgatgggagagtacagattcacgatatttttcatgctctctgcggtgtgatgcaggagagcatctgaagggtagggggatgcacaaagaatgggcagagagcgcgtttttttgtcccaagtcatcccctttactgagcaaaaaaaagaatatctcctatatgagaatcatcaatcggggttaataagttttgcgtccccagagtgttcaatattgataggagtcatattatggaaggtaaaaacaagttcaatacttatgttgtttcttttaattatccatcatcttattcctcagtgttcttaaggttaagatcattgatgtatgatatgaatttctcctctatcgtggctgatgaatatgggataccacgacaattgaatgaaaactccttcgcaataacgacatcgttagccgcaagtgaaatcgaagatttaatcaggcttaaatgcttagacttaccggatattgactttgacctcaacattatgacagttgatgactatttccgtcagttttacaagtagccaggaaggataagaagaacataaaaaatggcactattctctaaaatattaattttttatgtgattggtgtgaacatatcctttgtcattatctggtttatctcacatgagaaaacacatattcgtttacttagtgcattcctggtcggaataacctggccaatgagtctgcctgtggcattacttttttctctcttttaggagctgtagttgagtggacccgctggttatcgtgaaacgaagcgtctctcctcaaaactggatttgcggaacgatgaacgaagcagtcgcctgactgcttcgttcattaaagtgaaatttatttctgtgggcgcatcgccgggaagagaataacgtcacgaatagtatgactgtttgtaaacagcataatcattcggtcgatgccaatacccagaccagcggttggcggcagaccatattccagcgcagtcacgtaatcttcgtcatagaacatggcttcgtcgtcacctgcagctttagcgttaacctgttcctggaaacgttcagcctgatcttctgcgtcgtttaattcgctaaaaccattaccgatttcacgaccaccgatgaagaattcaaaacggtcggtgatttccgggttaacatcattacggcgcgccagcggggacacttctgccggatattccgtaataaaggttggctgaatcagatgtgcttctgccacttcatcaaagatctccgtgacaatacgtcccagcccccagcttttctctaccgtaattccgatagattcagctaatgctttagcagcatcaaaattatccaggtcggccatatcggtttctggacgatattttttgattgcttcgcgcatggtgagtttttcaaacggtttgccgaaatcaaacacatgctcgccataagtgactttagtggtacccagaacctcttgtgccagggtgcggaacagtgactctgtcagttcaatcaaatcgtggtaatccgcatacgccatgtagagttccatcattgtgaactcaggattatggcgaacagaaataccttcattacggaagttacggttgatttcgaatacccgttcaaaaccgcctacaaccagacgtttcagatacagctccggcgcgatacgcagatacatatctaaatccagagcattatgatgggtaataaacgggcgagcagatgccccacctggaattacctgcatcatcggggtttctacttccataaagccgcgcgcgaccatgaactgacggatagcggccagaatttttgaacggacaacaaacgtttgtcgggatttatcgttagcgatgaggtccagataacgttgacgataacggacttcctgatcctgcagaccatggaatttatctggtaaaggacgtagtgcttttgtcagcaggcgcaactcagtacagtgaatggaaagctcaccggtttgcgtcttaaacagcgtaccgcgggcaccgataatgtcacccagatcccattttttaaactgatcgttataaacaccttctggcaggctatctcttgcaacgtacagttgaatacggccaccgacatcctgcaacgttacaaaggaggctttccccatgatacgacgggtcatcattcggccagcaaccgagacttcaatgtttaaggattccagttcctggttatccttcgcatcaaactcttcgtgcagctggtcagaggtatggtcgcggcgaaaatcattgggaaacgccacaccttgctgacgtagtgccgccagtttttcgcggcgatttctcagttcatcgttaaaatcaatagcctcattggctccccgtgtttcttgttcagacattttggttcctctaaatccagctttcaatttagcgtagataaagagacagatcggtacactgtattatctgcctcgactattaataactcagtttatcttatcgaaactaacgcttacctcaagttgatatcactaataaataaccatcaaaatggtttaaatgacttattaatctagatttgctagtgttataaactgaaagttaatttattcataaccaattgtttttacgacagttaatcgttgctctcctgtatcatattcgtcggcgtgctaaacagaaaacgggtagcaaaggccaatacgacgatgatcgcgacacaagccaacgtccactctcccatctgagaaaagaatcgctggtaagctgcaattgccataccgctaatttgcgactctgtcgtctgctgtgccacgacgcctgccagccagttggcgaccgcgcctgttgccagcatataaataccggttaatacgccagacattttcagacgcgtgatttgcgcaatcgccaccgggtcaataaagagttcggcaaagcccattagcgccaacccggatatcatcacgcccattgacgcttgaccgtcagccgctgcatgtcgggcatcaaatgccaacaacataaagccacaagccatcagcagtaagccaaaggcaaacttcagccagacgcgcaatgttgagttgccgcggctttctggcgatgccagccaggccagcacaaccccagcgagcatcactgcaattgcattcaccgactggaatagtgctgtaggtacttcaatattgaatgcctgacgattcacaaagcgatcgataaacaagctgatggtactgccgccctgttgtgccagtacccagaacaacgtcccgacaaacatcaacaatacaatttgccaaagagcacggcggtgttcggggaatttgatcatcatgcgggcaatgatttgtgcggcaatgaggcaaacgatcgccagcaaatatccggaccagtcgttctccagcagcagggtaaaaaatactggggctaaacagagcatcaccactaaccagctccatactggtaaggcaaatttcacgctagtgagcgcttttttatccatactacgcgtggactggaaatgacgatgcccgcttaagaaaatcaacaaaccgataaacatgccgccacccgcaagggcaaagccaacatgccatccataccactgagcagccaggccgcaggcgattggggcggcgatagaaccgatattgcccgcagcatacagcagcgaaaaaccgccatcacgtcgatgatcgttctcgtcgtagagctcgccaagcaaacagctgatgtttgatttgaataaaccgtagccacaaataatgattgccagcgccagatacaggctaaaggttgaatttgtatcaatgcccagcaccacatggccaagggtcattaacagcgcgccggcaatcactgcagtgcggttgccgagcaggcggtcggcaagccagccgccgagaataggggtaacgtaaaccagagaagcatatgcgctgaacaggctgatggcatggttatcatcaaaaccaagctgatgggtgagatagagaatgagtaaggcacgcatgccgtaaaaactgaagtactcccagatttggatcgccacgatatagtatatcgcgcgcggctgtgagggtgttttcatatgttctccttatgagcaaaaaagggaagtggcaagccacttcccttgtacgagctaattattttttgctttcttctttcaataccttaacggtatagcggccatcagcctgacggtatgcaccgtgaatatcggtttcaaagcccggatagtgagcgccgatttcacacagcatctgcaggaactccagaaccggacggctttcttcggtgatcatttcacccggcattaccagaggaactcccggcggatatggaaggatcatattggcgttaatacgacctaccatttcgtcgaggtaaacttcttcggtcataccgtgcagctctttctggaacgcagcatacggagtcattaccatcgtcggcagcacttcaaatgcgcgatacatcagatccggcagattgtggtgaacaatcagtttgtggatattctgagccagttcctgaatacgcatgttttcatagaattcaggatcttcacgatacagagacggcagcatgtttttcacacgcaggttcaggtcgaacgcacgtttgaagtcagtcagagcacgcagcaggctcagtgctttggtcttatcgataccgatgctgaacaggaacagcaggttatacggaccggttttctcaacaacgatgccatgttcgtcgaggtatttcgccacgatgctggccggaataccaaagtcgctcatggtgccgtctttttccatccccggagtcagcagggtgactttgatcgggtcaagatacatgtgctcgttatcgatgtttttgaagccgtgccaggtgctgtcagaacgcagcggccagcattcagtcgtatcgatatgatccggctgccatacatcaaagaaccagccatcagattccgttctcagacgtttgatctctttacggaatttgatcgcacgttcaatggaaccgttgatcagacgtttacctgcattgcctttcatcatcgccgcagcggtttcagtggacgccacgataccgtagtgcggagaagtggtggtgtgcatcatgtaggcttcgttaaaggtttcttcgtttacgtcacctttaacgtggatcatggaagcctgagagaacgccgccagcagtttgtgagtggactgggtttcgtaaatcactttcccttctacacggccaccgctcataccgcatttaccttcgtaaatcggtgagaagttggtgtaaggcacccacgcggagtcaaagtggatggatttcacatccagtgttttcttgataaagtcggtgttgtacagcagaccatcataggtagagttggtaattacagcatgtaccggccaggttgcgtttggtgtttctttcacgcgcttagcaatggtagcgtgctggaattcactctgtgggataccaccaagaataccgtaagcgttacgggtcgggcggaaatagattggcgtaacatcgctcatcatcatcaggtgggtcagcgatttgtggcagttacggtcaatcagaatggtgctgcctgctggagcagagtacataccaacaattttgttcgcagtggaagtaccgttggtcaccatgtagctgcggtctgcgttaaagacgcgagcgatatactgttctgcttctttgtgtggaccactgtgatccagcagagaacccagttcagatactgaaatggaaatatcagatttcatggtgttcggaccaaagaaatcatagaacaggctacctaccgggcttttctggaatgcagtaccgcccatgtgaccaggagtacagaaagtatatttaccttcacgaacatatttaaacagtgctttagtcagcggaggcagaatagtgttgatatattcgtcagtggtctgcttgatcttattagcaatatcttcagcagcacccagcgcatattcaaagaagctaatctgtaaacgcaggtcattcaggcttacatcgagagtggaatacgtattagcgaacgcgtacaacggcaggttctcgttcattttgctaatttcttcgcacagctcgagattatatttatcccagtcaaaaataacgccgcacagacgcgcattgttttcgatcagttttaataagtcgtcacggtcgttcgggtaaacaatctggaagttcagacgttcaagcgcgcgatgaagttcacggatgggttcttctttaaaataaacccccatgtgattcaatattgcaataacgttcatagtcatatctccaggtaaaaaaggcccctcccaacacatgggacaaaatgaaaggaggagcctcggaaaatacttttaattaatgtgcgttagacgcggtgtggttatccattgagtggctctggcgctcgtgcattttgcgagcgtagaacatcaggataatcaggctgacgatgaaggtacctgccagctcgaaggagcttgcgcccatcagcgcgatgaagcagaacacgcaacccagtacagagcagatcaggctgacaaagttgcggatgttaacgccttcaaaacgaatcaggtcaacgcaagagtagaagtacggcagcatagtcagcagtactgcgataccggtcagttcaccgaacaggtcagatgctttaccaccggcagagttcatcagagtgatgaggatcatcagggcagtcattttcactgcagccagcagcagaccttttttcggaataccgttgctgtcgacttcaccataaactttcgggaagttaccgtcgttagcggcacgtacacctgcctggcctaccaacatcatccaggagcccagagaagtcaggcacgcaaaggcggtgaatgcagaaaccagcggcgcagcccagttaccgaggatggttgaagcactgattgcaaacggagcaccggaagctgccattacagaagatggatacataccggaaagcacctgagtcgcagcgatgtaaacaatacctgctaaaccagtacccagcatggttgccagcggaacggtacgtttcgggtttttaaccataccagtacttactgctgcggattcaacacccacgaaggcccacaggcagagcagaatacttttaatgatcgcatgaccatcagtggtatccgcagtattccagttagctgcataagttgccgcatcaaaccaatgccagccaacaatagcagtcatcaccacaggaataagaaccagcaccagaccaatagtggttaaacggcttacccaagtaccgccgagcatatttacaaaggtaaatacccagacgatagcaatacaggcgatacccgccggaacaggatcatttaatactgggaagaaggtggaaagataagataccgcggtaataccaatcgccaggttaccaatccagttagcatggtaataaagaacacctgtctgaaaaccaaatgcaggggaaatttctccggcataagcaattgggccaccttgttgcgggttttttgttgccagtcgggcatatacatacgccagcgacattgcaccaataatagagataatccaaccccagatagcaataccaccgatacttgctaggttcgcaggtaataatgcaataccgctccccatcatattaccggcaacaacaccggtacaggcaaatagcccgatcttcttggcagaactcatgctcttctcctaatttcatttttgaatttggagtccgggtcatgatgtataactatttcctgaccagaccaaactggcgctaagaatactcacgaaaaaaggattaatcctaaagattaggtgaaataatacaaaagtttctgtaagtgagaacttgaggttttttattaacacatcaggatcgcaagttgatatcatgaaaagataaacattcaatgtttacaatggattgcgggatattctctggttaaatttatgtaataaaaattatgcggcaaataaattgccgcaacatattataccaacagaaacatacaaaaactcaacaacaaatattcccgagcataaatcaacccgggagttacttattctgaagcgagaaatttgtcgagataaggtacaacataaggaacagaagtctggaatataccattttcaatccagtaaagggtgtttgcccctgggcgtaaattaaaggcggtgagatatgcatcagccgcttcccggttcatccccttcatttcataaaccttgccaagcaacacataatttagccaggacatttcaagatcaatgccagtatttatcgcctggtaagactcatctgttttaccttttaccagagcactgaccgcttttatttgatatataatggacagattattcaattccggcagtgtaacaatgttgtctatttctgtgttcagtgctgctaattgtttttcatctaaaggatgttgagaatggcgcacgatatcaactaatgctttttctgctctcgcgtaggtaaattctggggatgattgaacaatctcacctaataattcactggcacgattcaatgatttatcatcgccatgcagtaaataatcatgtgcctgataaaaattagttaataacgcaccacgatgaggcaatatttgctggagcgtctcctgcattcgttgtggccacggttggtttaacgcttttgataaactctccagtaaatcattttgaatcgccagctgattaccgttagtgatgacataacgtttatccagcatggttgaaccatctgcattgtctaccaattttatcgacataaagcattgttgagcacggtattggcgctgattaacaaaggcaatagataatgttttaccggaactgctcggttcatcaatgttgtagttgattttgtcatgcaccataaaggtggagaaggtgttaagtgatgtcgccaccaaattacccacgcctatcgcgtaagagagctgatacggggaactccagctgttacaacttttatttaccatattaatgtcaatatcgcgtggattgagcaaaatacgcgatttgctcataggaagacgtgtatcaagagttgaaaacgctaccagtgctacacagatacctaacgacaacaggaaaaaaaaccatacccaaaaggtagtgaatcgtttgcttttaattggggattgttcaggtggcgttgcggtgttttgaatgttaagactgtgggagggagaatctgtggcaggaaccgcctctggtatagggggaggcgaagatagcattatttcctctccctcttcttcgctgtaccagataaccggcaccattaatttatagccgcgctttggtacagtagcgatatagacaggactatcttcatcattatcttttaatgacttacgtagttctgagatactctgcgtcacaacatgattggtgacaatacttctcttccagacattatcgataagttcatccctgctaagtacttcgccactgtgttgagcaaagaaaaccagaagatcgattaatctcggctcaagggtaagttgacgcccattgcggctaatttggtttatggacggagtaacaagccattcgccaacgcgaactacaggttgttgcataatagaaactcattcgaaaagggaatgatgcaatgataattgccacaacctatttttaccatctatagatgggtttatttacatattattggtgaatgtaagacgttatttttaccagccataaacttcttgattacatagtattacgaaaggattttactgagaaccagaagtaatattccttaccatcaaaattcatcatctttgccaaagaaaaatgttcagaaaataatccatggaaaattgtccggagcgcttactattttaatggattgttagtctttgcatgagcaagcggactgatacatttctctttgttctcattcagaaaatctcatcagtcggcgttcagaccggtgttgtgctttatggatgcgttacgctcctgatgacgtcatttgacgttcaacaacatcacggggccgcacgacatttcacgtcagttagtgctatcgctcaggaacaaattttcccgaattgggatatgcccgcaaattgctggtgatgaggggagaatctggttgagttcgggagaattgatttggaggcagaacgcttaaatcgtggcgtcctgaaacgaaaaacggacctccgtggaggtccgtttatatgaatttggtgcccggactcggaatcgaaccaaggacacggggattttcaatcccctgctctaccgactgagctatccgggcaacggggcgcattaaaccgtaatctgcacatctcgtcaacctaatttcagtaaaagcgattcaactgcttaagattgcggcaaatcgcttcttttctgtgtttctgtcaggtcaatgcaccaccctggcggcagcgggcgaagcgcaggatatcttccgccagccgatgtgcagtgtcgacatccgcctggctacgattcaccagcattcggcttaaacagccttccagcaccagttccatctgctttgctaccatcgccggatcgtcaacttccagtgtggttaacagttcgtgggtgaaatcgtaggccgcgcttttttgctgatcggccagttgatgaatagggtggccaggatcgggataaaacgtacaggcagcgataaatagacagcccggatagcggttgtttttaacgcactccgataacgcctgataacgtgccagcagcttttgttcggcggtttgcgtttcgtccagcatcagctgacgacgccagacatctatctgttggctaagataacgcagcgcatcgtagaggattgcctctttgtctggccagaagcggcgtagctcgtccagtggataatccacacgttcagcaaccatctccagcgtggtgttggcaatcccttgtaattctaataatttcagggcttctcccagtacatcttcacgttgcacgctattttcctccgtctttcccactgcaagtgtcgttcacggttggcgatcgcgcaaatgtgcgctgaaggtttcagcatccataaagcccgtgacgcgtgcttgtggatgctcctggccttgtccgtcaaaaaagagaattgtcggtaggccaaggacattaagatgctttaacagcgccacatcttgtgcgtcgttggccgtgacgttggcctgaagtaagaccgtgtctgctaacgctttttgcacctgcgggtcgctgaaggtgtatttctcaaactctttacaggcgacgcaccagtcggcataaagatctaacatcaccggtttgcctttggcttcaacgagcgcctgatttaactcatctaccgttttgatttgtgtaaagttgagatgcgtctgagtttgcgcggtatgcgtcgcaccaaatgcccaatcctgaagtgggcgcacgctaaccaatgccgctgccagcaggattatttgcaccacgcgcatccagccgcgtttagcctgtaggctggtgataaaggcccagccaaagaatgcgacacccagcgccgaccacaagcgtaatccccatacatcaccaatcactcgctccagcaggaagaccggcagtgcgaggatcacaaaaccaaacgcggttttgacttgttccatccacgggccgcttttcggcagcaagcggttaccaaagacggtaattagcatcagcggcaggcccatgcccaacgcatagagataaagcgtgccgccgcccagccacatgttcccgctttgggcgatatacagcagaatcgcgctaagcggtgcggtggtgcatggtgaacagatcagtccggcaatcgcccccataacaaacacaccgccaggtgagccgccctgttggcgattgctcatcaacgtgagacgtgtttgcagcgaagaggggagttgtagagtaaacaagccaaacattgacatcgccagcaaggtaaagacgatggcgaggccaatgagcacgtatgggtgctgtagcgccgcctggaactgtaaccctgcggcggcaactaccagacccagcgccgtgtaagtcagtgccatcccctgcacataaataaaggtcagcaacaatgctctggcagtggagagccgctgtttaccacccagcacgatgccagaaatcagtgggtacattggcagcacgcatggcgtaaaggcgataccaataccgatcaacaacgcccagagcgcggaaaagggcaattgcgcggtgtgctgctcttgctgcgaaacagacacaggctgtgacgctgcgttgttggcgaccacttcgcttaacggaacggttttggtttctggcggataacagaaaccggcatcagcacagccctggtaggtgacagttaacgtcgctcccgcactcgcctggttgatggttacgggaagcgtcagccgatcgcggtaaatctcgcttttgccgtaaaactcatcttcatgccagacgccttgcggcagctgcacgtcggcaattttcgcgtgttccggcgtaatgcggatctgtttacggtagaggtagtaaccgtctttgatctgccaggtcagattaaggtcatgttggttttgctgaaaatcaaaagtaaaggcttgatccgcggggacaaattgtgaacgtcccggcgcgtcgaataatccggcaaaaacggaagtgctgcaaagtagcaggatcagcgtaaagatgcgttgagccatgagaggtaatctgtgtctccgtgtgtaacaggtaaaaccagaagttccggggtttgatatggatgatgagacttcaggcattccagcagtgcctgctggtgagatacggtagtttttaaaatcatctgcacttcgtattcttgctccagcttaccttcccagtaatagagagaggtagcgccggggatcaaggtcgcgcaggccgccagtttttccgccagcactttggcggctaaatcctgggctgtcgcttcatccggtgcggtacatagcaccacgacagacgcggtattcgaacttttttcatcaagcataaacacctcgcaagaacagatggaaccgcaagagagaggtcactatacaacggacgggggaaggatgttagtcggcgggaaagaaagcggggcgtgaacgccccgcgattggtcattacagcatgaagctacccagcacgaagccgaagcaaacggccagggcaacacccagagtacccgggatgaagaacggatggttgaagacgaatttaccgatacgggttgtacccgtgtcatccatctgtaccgcagcaaccagcgtcgggtaggtcggcagaatgaacagaccagacaccgcagcgaaagaagcaacagcggtcagcggtgaaacgttcagtgccagggccatcggcatcagtgcttttgcggttgcagcctgagagtacagcagagcagaagcaaagaagaagatgacggccagcagccacggatgaccctgaatcacttcaccagcggtatctttgatccagtcgatgttgttggaaacgaaagtatcgcccagccacgcaacacccaggatacaaatacaggcgctcatacctgctttgaaggtgctggagttgaggatgttgtcggtatcgactttacagataacggtggtcagagttgcaacgctgagcatgatgatcaggattgcgttggtggtgttcatcagcggtttttcaaccagacccatgcttgggctgttgatgattgcatagataaccacgccaactacgcccagcaggaacagccagacggacgtttttgcaccggatttgatttcaatctgcttttcaccgcgcagttcaaccaggccctcttccagacgcttgcgataaatcggatcgtcagagagtttggagttgaacagcatagtgaccagaaaggacatcaccagaaccgccagcagggtggacgggatgaccacggagagcagatggaggtagctgatgccatgaccttccatcacggaagacatgtaaaccactgccgctgagattggcgatgcggtgatcgcaatctgcgcggataccactgcagtagacagcggacggcaaggtttgacgccttgttccttcgcaacttcagcgataactggcagtgtcgccagagatatgttgccagtaccagcaaagatagtcaggaaataggtcacgatcggtgcgaggatcgtgatgtatttcgggttacggcgcagcagcttttctgtctgatgaaccagatagtccagaccgccagcaacctgcatggcagaaatagcggcgataaccgccatgataatggaaatgacatcgaacgggatgttaccgggtttaacgccaatagcggcaagaaccagcacccccaatccgcctgcaaaaccaatacctattccccccaatctggcgcccaagaagatcgccagcaaaactatgatgagttctacaactagcatattagccttccttgttttttaacaagttgatattaggttgttatttttaagttactgctcacaagaaaaaaggcacgtcatctgacgtgccttctttatttgtactaccctgtacgattactgttcgctttcatcagtatagcgttttgctttgtaagccgggtgcatcagattctgtacggagaaaatatcgtcaagttccgcttcagtcaacagaccgcgttccagaacgacttcacgtacactcttaccggtttcggcacagattttacccacgatgtcaccgttgtggtgaccgatgaacgggttcaggtaagtaacgataccgatagagttgtaaacgtaaccttcgcacacttctttgttagcagtgatgccgttaatgcatttttccagcaggttgtagcaagcgttggtcagaatgtgaacggattcgaacatggcctggccaatgaccggctccataacgttcaactgcagctgacctgcttctgctgccatggtaacagtggtgtcgttaccgatgactttgaagcatacctggttaaccacttccggaacaaccgggtttactttagctggcatgatggaagagcccgcctgcagttccggcaggttgatctcgttcaggccggcacgtggaccagaagagagcaagcgcaggtcgttacagattttggacatcttcacagccaggcgtttcagcgcgccgtgaaccataacataagcgccgcagtcagaggtcgcttcgatcaggtcttcagccggtacgcatgggaagccagtgacttcagccagttttttcactgccagcggagagtactctttcggcgtgttcagaccagtaccgattgctgttgcgccaaggttaacttccagcagcagttcagcggtacgttggatatttttcacttcttctttcagcaggatgctgaaagcgcggaattcctgaccgagggtcatcggtactgcgtcctgcagctgggtacgacccattttcaggatgtcctggaattcgacagctttacgttcaaagccttcacgcagttggttaatcgcatctaccagcttaatcagggaagagtaaactgcgatacggaaaccggtcgggtaggcgtcgttagtggactgacatttgttaacatggtcgttcgggttcaggtactgatattcacctttctggtgacccatcagttccagaccgatattggccagcacttcgttggtgttcatgtttacggaagtacctgcgccgccctggtagacgtctaccgggaactgatccatgcattttccgttgttcaggacttcatcacatgcggcaatgatggcattcgctacacttttaggaatggtttgcagctctttgtttgccatagctgcggcttttttaaccattaccataccgcgaacaaattcaggaatatcactgattttgttgttgctgatatagaagttttcaatcgctctcagagtgtgaacaccatagtaggcatcagctggaacttccctggtacccaacagatcttcttcgatacgaatgttgtttgacatgtgaaccttctttttcaagctgccaatgatttgctttaaacacacagaatatatgtggtttcgaatgtttttcgaccgacgattatcccctgcatcgaccgaatacccgagatcatatgctgcttgaggatttctaccgtaatctggatcactttaagtgtcggtttttaccccttaattattaatttgtgaaatagatcaccgctttgggattactaccaaaaatagttgcgcaaacatcttgaaattttgctaatgaccacaatataagctgaacgcgattcgcaacccattcaggtagccgggttttaccggctgctattacaggagaaacctttgcgctggttaccttttattgccattttcctttatgtctatattgagatttcaatctttattcaggttgcccatgtattgggggtattgctgaccctcgtgctggttatattcacgtcagttatcgggatgtcactggtacgtaaccagggctttaagaatttcgtgctgatgcagcaaaaaatggcggcgggtgaaaacccagcggcggagatgattaaaagtgtttcgctgatcattgccggtttgctgcttttattaccgggctttttcaccgacttcctcggtcttctgcttttattaccgccggtgcaaaagcatctgacagtgaagttgatgccgcatttgcgcttttctcgtatgccaggcggcggttttagcgccgggaccggtggcggtaatacttttgatggtgagtaccagcgaaaggatgatgagcgcgaccgccttgatcataaagacgatcgccaggattaatgtcgaaacgccggattatgtggttatgccattttccggcgtttttcgttttggcagcaacagccataaccccgccagcatgatcagcgcatagagacttttccagccgaccattgccagtaacagaacgcataacagcccgccaaccaccgccagtagtcgataacgtccttgcaataatttacagcctgccagcatgcataacagataaatcataataaagatgccattggcataaataataagagcgtccagattgatctctaaagcatgaatcaccaacgtgctcaccacacagcagccgagcaccgcattgagggcattattcgggatatggcgagaagagaggcgtgccaggtagtggtcaggattatgttgcgcctgcgaccagaccaggcgggcgaagctctgtatataaatgttgagactggcaaagcaggccagatagccaatcacgcaggcaatccataacgctcctacaccgaacaactgcactacaatttttggaagcgatgctgccgccgccattttttcaccataggcgtcgaagtgtaagacgactaccgtacagccccagtagactaatcctgccagcagcagaccaatcatcaatgcgcgaggaaaatcacgctctggatttttaaattccgaggcaagatgggcaaatgcttccagaccgacaaaacaccagaacatcactgataacgcagcaaataacccggtaagttcgatattaccaggtgccgggaaggggatattcgcaggtttgatatcgcccgcccaccagatagcgacaatcagcgcgacgataagtccggcaataacggtttgtagattagcactggaactggcaccgcgagtaccgatataccacaccagcgccagcgtaccgagttctgccaacaacagttgccagctatgccagccaaacattgcctggccgaacccggcggcaatttgtagcgcggcaggcaaacccacgggaatgaccgataaaaacaaccagccggtgactcgctcaagtcgcgaaccaaacgccataccgacgaagtgcgcgacaccgcctgcgctgggatagtggcgacccagaatcgcaaacacaatcgcaatcgggaacactaagataatcaaaacgggccacgcccacaggctgttattgcccgctaccagcgcagctaacgcaggaacggcaaacacgccagtgcctaataatgacgtcgatagcaggccaatgccctgggccagccccagttcttgtttgagtccactcatgggttgatatccgattgcgcccaaattttgggcaactgcgtagattttcgatggtagcacaatcagattcgcttatgacggcgatgaagaaattgcgatgaaatgtgaggtgaatcagggttttcacccgattttgtgctgatcagaattttttttctttttcccccttgaaggggcgaatcctcatccccatttctctggtcaccagccgggaaaccacgtaagctccggcgtcacccataacagatacggactttctcaaaggagagttatcaatgaatattcgtccattgcatgatcgcgtgatcgtcaagcgtaaagaagttgaaactaaatctgctggcggcatcgttctgaccggctctgcagcggctaaatccacccgcggcgaagtgctggctgtcggcaatggccgtatccttgaaaatggcgaagtgaagccgctggatgtgaaagttggcgacatcgttattttcaacgatggctacggtgtgaaatctgagaagatcgacaatgaagaagtgttgatcatgtccgaaagcgacattctggcaattgttgaagcgtaatcctcgcacgacactgaacatacgaatttaaggaataaagataatggcagctaaagacgtaaaattcggtaacgacgctcgtgtgaaaatgctgcgcggcgtaaacgtactggcagatgcagtgaaagttaccctcggtccgaaaggccgtaacgtagttctggataaatctttcggtgcaccgaccatcaccaaagatggtgtttccgttgctcgtgaaatcgaactggaagacaagttcgaaaatatgggtgcgcagatggtgaaagaagttgcctctaaagcgaacgacgctgcaggcgacggtaccaccactgcaactgtactggctcaggctatcatcactgagggtctgaaagctgttgctgcgggcatgaacccgatggacctgaaacgtggtatcgacaaagccgttaccgctgcagttgaagaactgaaagcgctgtccgtaccgtgctctgactctaaagcgattgctcaggttggtaccatctccgctaactccgacgaaaccgtaggtaaactgatcgctgaagcgatggacaaagtcggtaaagaaggcgttatcaccgttgaagacggtaccggtctgcaggacgaactggacgtggttgaaggtatgcagttcgaccgtggctacctgtctccttacttcatcaacaagccggaaactggcgcagtagaactggaaagcccgttcatcctgctggctgacaagaaaatctccaacatccgcgaaatgctgccggttctggaagccgttgccaaagcaggtaaaccgctgctgatcatcgctgaagatgttgaaggcgaagcgctggcaactctggttgttaacaccatgcgtggcatcgtgaaagttgctgcggttaaagctccgggcttcggcgatcgtcgtaaagctatgctgcaggatatcgcaaccctgactggcggtaccgtaatctctgaagagatcggtatggagctggaaaaagcaaccctggaagacctgggtcaggctaaacgtgttgtgatcaacaaagacaccaccactatcatcgatggcgtgggtgaagaagctgcaatccagggccgtgttgctcagatccgtcagcagattgaagaagcaacttctgactacgaccgtgaaaaactgcaggaacgcgtagcgaaactggcaggcggcgttgcagttatcaaagtaggtgctgctaccgaagttgaaatgaaagagaaaaaagcacgcgttgaagacgccctgcacgcgacccgtgctgcggtagaagaaggcgtggttgctggtggtggtgttgcgctgatccgcgtagcgtctaaactggctgacctgcgtggtcagaacgaagaccagaacgtgggtatcaaagttgcactgcgtgcaatggaagctccgctgcgtcagatcgtcctgaactgcggcgaagaaccgtctgttgttgctaacaccgttaaaggcggcgacggcaactacggttacaacgcagcaaccgaagaatacggcaacatgatcgacatgggtatcctggacccaaccaaagtaacccgttctgctctgcagtacgcggcttctgtggctggcctgatgatcaccaccgagtgcatggttaccgacctgccgaaaaatgatgcagctgacttaggcgctgctggcggtatgggcggcatgggtggcatgggcggcatgatgtaattgccctgcacctcgcagaaataaacaaacccccgggcagaaatgtctgggggtttttcttttggtcatctttctagtataagattcagacacggacgacgcgagtggcgtccagctcattgattatggggaataacatgcacgtaaaatacttagcagggattgtcggtgccgcgctactgatggcgggttgtagctccagcaacgaattgagtgctgccggtcagagtgtacgcattgtggacgagcagccaggcgcagagtgccagctgattggtactgcgacaggtaagcaaagcaactggctttccgggcaacacggagaagagggcggttctatgcgcggcgcagcaaacgatctgcgcaaccaggcggctgcaatgggcggtaacgtgatttatggcatcagcagcccgtcgcagggaatgttgtccagttttgtcccgacggatagccagattatcggtcaggtttataagtgcccgaactgatgtgatccagaggctgggtgacaaacgtattattgcctgatgcgcttcgcttatcaggccttgtattatccctccagtgcagagaaaatcggccagttttctctgcctgcagtccgcatgccgtatcgggccttgggttctaacctgttgcgtagatttatgcagcggactgcctttctcccaaagtgataaaccggacagtatcatggaccggttttcccggtaatccgtatttgcaaggttggtttcactatggaacatgaacttcattatatcggtatcgacaccgctaaagagaaactggatgtcgatgtgttgcgtcctgatggtcgtcatcgcaccaaaaaattcgctaacaccactaaagggcacgatgagctggtgagctggctgaaaggtcacaagattgaccatgcgcatatctgcatcgaagcgaccggcacctatatggaacctgtcgctgagtgcctttacgatgctggctacatagtgtcagtcattaatcctgcgctgggtaaagctttcgctcagagtgaaggactgcgtaacaagactgataccgtggatgcgcgcatgctggcagagttctgtcgtcagaagcgccctgcagcctgggaagcgcctcacccgcttgaacgcgcgttgcgtgccctggtagtccgccaccaggcgctgacagatatgcacacgcaggaactgaatcgcactgaaacggcgcgggaagtccagagaccgagcattgatgctcaccttctgtggcttgaagcagagctgaagcgtcttgagaagcagataaaagacctgacagacgatgatccggatatgaaacaccgcaggaaactgctggaaagcatcccgggtatcggagagaaaacatctgcggtattgctggcttatatcggtctgaaggaccgcttcgcccatgccagacagttcgccgcttttgcgggtctgacaccacggcgttatgaatcaggtagcagtgtgagaggggcgagccggatgagtaaggccggacatgtgtcgcttcgcagggcgttgtatatgcccgcaatggtagccaccagtaagactgagtggggacgggcgttccgcgaccgtctggcggctaatggcaagaaaggaaaggtgattctcggcgcgatgatgcgcaagctggcacaggtggcgtatggagtgctgaagtcaggcgtgccgttcgatgcgtcacggcataatccggtagcggcgtaaaaatcgcggaagggatgaaaaaaacagcgcctgacggcgctgtgtctggcatgcctgcaatccgggaaaccggaccaggaaaaaacttgcaggccataacagtatctacagcaggcattgcaactgattgaatgcttgagaatttgtaggccggataaggcgtttacgccgcatccggcatgaccaacgatcacgttatcagtcatttcaggctggatggctccagcctcgcattagcaaagatgagattatttcgcctgtggtgcagttttgctggtggattgaacacgtaagtgatgcagcgcgcgtaagcattgatcctgggttagcggttgggcgttattcgccgctacggtgcgaacatagacctgacatggcacacccgcgagttttttcagtcgtgggctgaaatcaagcattcggcgagtgatcgcctctatttctttacccggcgttgcttcacgcgttttcaccactgcgccgctaaattgttctttgccactttcatctttaaagcggtaaagcaccgccagataatggtcgaacaggttatgtttccattccggttgggaataggtgtcatattccagattgccattttcctggcagtcaacgtcatataacggcaggaaatctaacagtgaggtaatacgtaatgccagttcacgcatttccgcattattaattgcatgaatgattgctcgcgccagcatttcaatctgcaactcattgacgactaactcacatttgctaccgtcatgtagcgttaatacgaaggtaagattttcgccttgattatcggtaagttccagcgtgttaacccgacgattaatatcggcatttttaagctcatcaaccagaatttctgggatgttttctgccattttcttaatgactttatcgcgagcttgctcatactgaaggcgtgcagcagcatccagtttatgcttttgatgcagacgactttccagcgcaatcagcaggtcgcgcagttccatgacagacataaagaacaacgattctttattgcgaggttctttaattttcagcgccagtgcaatgaaattattactcttgcgaataacaccggtattaacacccttgatgcttatggccatgtaggttctccctaaccatttctcaattaaataattaattttaatttataagccagataaatgggcttggtagtaatagttgttaaaataacataaatagccgtactcactctatataaacagaaaagaaaggttaattattggtgttggctatataaagagtaacaacagcaatgtatatgaataattaaaggttatgcaacgggcaaagattaaatttcccagtttaatgacaggttgctgtacttgcgtttgttgctcttgccggatgcggcgtaaacgccttatccggcctacagttcattgcaaatccattcaatttcaatgcacaatgtaggcctgataagcgtagcgcatcaggctaatgtttaacttccctgtttaatcagttactgctggcgtagctggagatccagcggcgttttgctgggttcgccgccaatttctcgcgccagtttcggcaccagatatcccgacaccaatgtcagcaactcacgcataatctgccgtgcttcgtcatcactcaccataaaatgcgccgcgccctgtactttatctagcacatgcaggtaatacggcatcacgccggcatcgaacaacgcattactcaggtttgccaacgtttgtgcgttatcgttcacaccacgtaacagaacgctctggttaagcagggtgacaccgacacggcgcaatttagccatcgcctgacggaacgtttcatctacctcattggcatgattgatgtgattcaccagcaagatttgcagcgtagaacgggcaaagcgttcaaccagcgcctcggtgatacgtgccgggatcacaatcggcagacggctgtgaatccgcagacgtttgatatgcgggatggcttccagttgtgtgagcaaccagtccagctcgtgatctttcgccatcagcggatcgccgccggagaaaatcatctcgtccagttccggatgcgcagcaacatactcaagagcagtctgccagttacgcttgttgccctgattttcggcataggggaagtggcgacggaagcaatagcggcaatttaccgcgcagccgcctttgaccagcaaaagcgcccggttgtggtatttatgcaacaaaccaggcactacgctgtgctgttcttccagcgggtcggtggagaatccggacgcgacgacaaactcatcttgcgaggtaagtacctgacgcaaaagaggatcgtccggattgcctttctccatgcgatcgataaatgagcggggcacacgcagggcaaacagctttttggcgctgcgtccggccaacagtttttcgtccgcgtctatattcaaaagacgcagaagttcatcaggatcggtcacaacatcggcaagttgcgttaaccaatcttctctggatggggtatttagggttacaatatgcgccattttgtggcttagctaccaattaacaaatttcagagggccttatggcaacgtactatagcaacgattttcgtgctggtcttaaaatcatgttagacggcgaaccttacgcggttgaagcgagtgaattcgtaaaaccgggtaaaggccaggcatttgctcgcgttaaactgcgtcgtctgctgaccggtactcgcgtagaaaaaaccttcaaatctactgattccgctgaaggcgctgatgttgtcgatatgaacctgacttacctgtacaacgacggtgagttctggcacttcatgaacaacgaaactttcgagcagctgtctgctgatgcaaaagcaattggcgacaacgctaaatggctgctggatcaggcagagtgtatcgtaactctgtggaatggtcagccgatctccgttactccgccgaacttcgttgaactggaaatcgttgataccgatccgggcctgaaaggtgataccgcaggtactggcggcaaaccggctaccctgtctactggcgctgtggttaaagttccgctgttcgtacaaatcggcgaagtcatcaaagtggatacccgctctggtgaatacgtctctcgcgtgaagtaatgcggttgtggtgcggcctgcaggctgcaccatcacttattcaggtcagagatgatgaaacgccttatcgttcttgttttgcttgccagcacgctgctcacgggctgtaacaccgctcgcggtttcggcgaagacatcaaacatctcggcaactccatctctcgcgctgccagctaatttttcttctcttccgaaaaatcatcagatttccatcatttttggcgatgttgtctattattaatttgctataggcaaacataaataacattacctaaaaggaagacgttatggtgaagaagacaattgcagcgatcttttctgttctggtgctttcaacagtattaactgcctgcaacaccacgcgtggcgttggtgaagacatttctgatggcggtaacgcgatttctggtgcagcaacgaaagcgcagcaataagcaataacggtacgacagttatgtcgtgccgtttgtttttttgcgatagtcacaaaggtaatagttgaaattcccctgccacctggcaaaatatccgttcaaccatcagctttgcaggacgacctgcaaacgcctcttttcaccggggacggccccaattctccggagcctgatatgtcctggattatcttagttattgctggtctgctggaagtggtatgggccgttggcctgaaatatacccacggctttagtcgtttgacgccaagtgttattactgtgacggcgatgatagtcagtatggcgctacttgcctgggcgatgaaatcgttaccggtagggacggcttatgccgtgtggacgggtattggcgcagtcggcgcggccatcaccggcattgtgctgctcggtgagtccgctaacccgatgcgcctggcgagtctggcgttaatcgtattggggattattggtctgaaactcagcactcactaactaccgggctgctgtacccaaataaacttactgacatcaaacccttcccgggtcgcgactgccagcatctcctgtttcacttcgtcagaaatggttggcgtgcgggagagtatccacaggtagtcgcggtccgggccgcaaaccagcgcatggcggtattcccgatcgagtgcaataacgttataaccgccatagaaaggaccaaagaatgacactttcagcgcagcgcgagttggtgcgccggtaaagtacgctttcccttcactctgctgccacattcctctgtcagggttatagcctttattaatgacattcaggccgccgtcatcacgcaggctgtatgttgcggtgactttttccagtccacgttcaaaacggtgatcaaaacgggcaatctcataccaggtaccgagataacgtttggcgtcgaaattattcactactgttacgccacgcggcggcgtaggagaactgcaggcaacgaccagaaatgcagctgtcgctgcggcaacgagagggagcaggcgcataaatgtttccttactggtttttttctaagtgtagatgacagcaaggaaaagcgcagaaaaggtccgaaaattcggacccgatgaaattttactgtagagcgttgagaatctgccaggcggcggcgactctcgctggattgggatagtttttgttagccagcatcactatacccagctctttttctggaataaacgcgacatagctaccaaatccgccggttgcccctgttttatgtacccatgatgcgcgtactgcaggagttgggggcgtaatcgcttttacggggtgtgctgccagtgcaattttattgccactgccgttaatgatgctgtcaggatttaccggccagtccagcatttcccagcccaggccctgatacatatcgccggtttgccagtagcgagattgtgccagttgtatcccttgctgaagtgttttgtcgttgatatcacggggattcatattgcttcgtacccagcaggccatatcttcaatggtcgacttcacaccataagtttcagcatctaacgcccctggcgaaacatgaactgccttgccttcgcgatatccccaggcgtaattcttttcttctgcgggcggtacattaatccacgtatggttgagtttgagtggctggaagacacgtgtttgcatcgcctgctcaaaactcaaaccagacggcttcacagccagtgcgccgaacaaaccgatactggagttggcatacagacgttgtgttcctggcgcccatgcaggctgccagttttgatagaagcgcagcaagtcgcttgaggatttcacctcatccggcacctgcaatggcaggccgccagcagtgtaggttgcgagatgtaatagtgtgatcccattccactgtttagcggtaagttcaggccagtattttgttgtgggatcgcttaacttgatttcccctcgagcaatagcctcgccaccaagcacgcccgtaaatgttttgctgaccgaacctaactcaaacaacgtttgctgtgtgacgggctgctttttggcgatgtccgcatagccccaggtaaagtaataaggtttaccctgataaattaccgccaccgccataccggggatcttttgttgctctataagcggggtaattgtgcgatgcacaatatcgttgatttgttgaggggcagcaaatgtggagcaagaggcggtaattaataaggcgcagagcgtcgttttgaacataaggtctggtttccatacaaaacggcccgccataggcgggccggatttacattggcgatacgttagattgtaacgataccaatcagcgtgacaactgtcaggatagcagccagaccgtagaaaacccatttgcccgcaggcacgtgaattttcagatcgtgcatcgcgtggtgcatacggtgtaaaccacaccacagcggcagaacgatcatcaggaacaggaatacgcgaccaatgaagctctgcgcgaacgccagaacgcgctcgtagctcagcgcatcacccggaaacagccccagtggcagcagaatacccaccagcaggatcatcaccggcgcaataattgcgctccacataccaccggccccgaagaggccccagaataccggttcgtcagaacgctttggatttggattaatcatctcaggctccttaccagtacagggcaacaaacaggattacgatggtggcaaccacagttaccgcccagagacttttgataattggctctggtcccattttttcgtcttttacaatgatattggccgctttcggtgccagttcaaaccaggttttggtgtgcagcagagctgccgccagagtgatcaggttaatgatcacgataaccgggttttgtaaaaagtcgacgaatcccgcccaggcttccgggccatttttcagggcaaacagcccgaaaatcagttcaatgctgaaccacacagccggaaccgccgtgccttcgcgcagcatgtaaaagcgataaaacggcaattttttccaccaggtggacgtcattggccgtacatacggtttacgtttagtcgtcatgttgcactccttagcgtggtttcagggtcgcgataagaaagtctttcgaactttctactttgccctgctgaatggccgcagccggatcgacgtgtttcgggcagacttcggagcaatagcccacgaaagtacagctccatacgccgttctggctgttcaactgcgccatacgctccttcttaccgtggtcgcggctatcttcgttataacgatgcgccagcgtaatggcagccggaccgatgaactctgggttcaggccaaactgcgggcacgcggcgtagcacagaccacagttgatgcaaccggagaactggtgatactttgccatctgcgccggggtctggatgttagtaccctgatccgcggtgcgggagttgccgatgatgtacggtttgatcgcttccagactttcgatgaagtgggtcatatcgaccaccagatcgcgttcaatcgggaagttagctaacgcttcaaccttcataccgtcggtgtaatcacgcaggaaggttttacatgccagttttggcacgttgttaaccatcatgccgcaggaaccacaaatcgccatacggcaggaccagcggtaactcaggtccggtgccaggttgtctttgatgtagcccagcgcatccagtaatgaggtagttgcgtcataaggcacttcatagaatgcgctatgcggtgcggtatcgacttccgggttatagcgcaccacctcaattttcaggtttttcatctcagccattcgccttctccttcttattggctgcttccgccttatcggctgcatccgcttcgccaccgtaaacacgtttagctggcggcagcgtagtaatcttcacgtcgctgtactccaggcgagtcgtgccatcagcatcgcggaaggcgagggtgtgtttgaggaagttgacgtcgtcacgctcggtgcaaccttcgtccagacgctggtgtgcgccgcgggactctttacgtgccattgcggagtgcgccatacattcagcaacgttcagaccgtggcccagttcaatggtgtagagcaggtcggtgttgaacacgctggaggtgtcggtgatgcgcacgcgcttgaagcgttcctgcagctctgccagcttgtcgatggttttctgcatcagttccggcgtacggtagataccgcaaccttcttccattgccaggcccatttcgtcgcggatcttcgcccagttttcgccgccatcctggttaaccagatctttcagacgttgttcaacgccagctgcctgcgcttcaattgccgcttcgttgccattaccggcagttgctgcacgctctgtcgcttgttcaccggccagacggccgaagaccaccagttccgccagggagttggagcccagacggtttgcaccgtgcagaccaacagaggaacattcacccacggcgaacagacctttaatgcgggtttcacagttctgatcggtttcgataccgcccatggtgtagtgtgcggtcggacgtaccggaatcggttctttaaccggatcgacgccaacgtacgctttcgccagttcgcagatgaacggcagacgttcatgcagttttttctcgccgaggtgacgcaggtcgagataaaccacatcgccacgcggcgtggagatggtgttgcctttacgccattcgtgccagaaggcctgagaaactttgtcgcgtggacccagttccatatatttgtttttcggctcgcccagcggagtttccgggcccatgccgtaatcttgcagataacggtagccatttttgttgaccagaataccgccttcaccgcggcagccttcggtcatcaggataccggaacctggcagaccggttgggtgatactgaacgaattccatgtcacgcagcggaacgccgtggcttagcgccatacccataccgtcaccggtaacgatgccgccgttggtgttgtaacgataaacgcgacccgcaccgccagtagccataacgaccgcgttagcacggatctgcaccagcgtgccttccatcatgttcattgctaccaggccgcgaacatgaccatcatcaaccagaatatccagcacgaaatgttcgtcaaaacgctggatctgcgggaattgcagagaggtctggaacagcgtgtgcagcatatggaagccggtcttatcggcggcgaaccaggtgcgctcgattttcatgccgccgaagcgacgtacgttgacgctaccatccgggcgacggctccatgggcacccccacagttccagttgggtcatttcggttgggcagtggtggacgaaataatccacgacatcctgctcacacaaccagtcgccacccgctactgtatcgtgaaagtgatattcgaagctgtcatgctcctgcgcgacagcggcggagcccccttctgcagcaacggtatggctacgcatcgggtatacttttgagattagtgcgatttttgcatttggatttgcctgcgcggcagcaattgcagcacgtaatcccgcgccaccggcgcctacaatggcaagatcggcttgaaaggtttgcacgacattcctccagattgtttttatcccacagccccgtacttcagggtaagtgcctgaaagttacggtctgcgaacgctattccactgctcctttataggtacaacagtatagtctgatggataagtctgaaatttgacgagatcgatttttttagtgcgcaagagggctaaattatcactgaagatgattaatttaattactaaaccatcagatcgtgctttttttagtcactgcccaccgctgtttgattcctgcgtaaaatttgtctcgccgtcgcgttgcgagtagacttcgtgcccttgtcaaaaactggagatttaactatgagcgaaacggcatcctggcagccgagcgcatccattcctaacttattaaaacgcgcggcgattatggcggagatccgtcgtttctttgccgatcgtggagtgctggaggtggagacgccttgtatgagccaggcgacggtaaccgatattcatttggtcccgtttgagacacgtttcgttggccccgggcattcgcaggggatgaatctctggttaatgaccagcccggaataccatatgaaacgcctgctggttgccggttgtgggccggtattccagctgtgccgcagcttccgtaatgaagagatggggcgttatcacaaccctgagttcactatgctggagtggtatcgaccgcactatgatatgtaccggttgatgaacgaggtggacgatctcttacaacaggtgctggactgcccggcagcagaaagcctttcttatcaacaagctttcttgcgttatctggaaattgacccgctctctgccgacaaaacgcaactgcgggaagtcgcagcgaaactggatttgagcaatgttgctgataccgaagaagaccgcgacacgctgctacaattgctgtttacctttggcgtagagccaaatattggcaaagaaaaaccgacctttgtgtaccactttccagccagccaggcatcactggcgcaaatcagtaccgaagatcatcgggtcgctgaacgctttgaggtttattataaaggtattgagctggcgaatggtttccatgaattgacggatgcccgtgagcagcaacaacgctttgaacaagataaccgtaagcgcgcggcgcgcggtttgccgcagcaccccattgaccagaatctgattgaagccttgaaagtcggtatgcctgactgttccggcgtggcattaggtgttgatcgtctggtgatgttggcgctgggcgcggagacactggctgaagtcatcgcctttagcgttgaccgggcataattctgaaaaattactgaattaacagcgaagaatggcgtgataagcgccattctgtagcatatgttttcatttttccgttaaaggccacaatttaagactggatatttgatatcatccaggtatcaattctgtattggtttttacgctgcctgctcaatgttgcgcagtgcagttcagtgggcacgtgttatacacgcgctgaaatgaaggatggtttcatgcctcacacgataaaaaagatgagtctgataggactcatattgatgatctttacttccgtatttggatttgccaatagcccatcggcttattacttaatgggttatagtgcgattcccttttatatattttctgcattgttattctttattccattcgccttaatgatggctgaaatgggagctgcttatcgcaaagaagaaggcggtatctattcctggatgaataatagtgtcggaccacgttttgccttcattggtacgtttatgtggttttcctcttatatcatctggatggtgagtacctccgcgaaagtttgggtaccgttctcaacattcctctatggtagcgacatgacccagcactggcgtattgctggactggagcctacgcaggtggttggtctgctggcagtggcatggatgattctggtcaccgtcgttgcttcaaaggggattaataaaattgcccgcattactgcggtgggcggtattgcagtaatgtgtctgaatttagtattgctgttagtaagcattactattttgttattaaatggtgggcatttcgcgcaggatattaatttccttgcatcaccgaacccaggttatcagtccggtctggcaatgctatcgtttgtggtatttgctatttttgcctatggcggaattgaagcggttggtggtctggtcgataaaacggaaaatccagaaaagaactttgccaaaggtattgtttttgccgctattgttatttcaatcggttattcgctggcaatatttttatggggtgtcagcacaaactggcagcaggtattaagtaatggttccgttaacctcggcaatattacctatgtgctgatgaagagcctcggggtgacgctgggtaacgcactgcatttgtcacctgaagcgtcattgtcgctgggtgtatggtttgcgcgtattaccggactttcgatgttcctcgcttataccggggcgttctttacgctttgctattcaccgctgaaagccatcatccaggggacgccgaaagcgttgtggccggaaccgatgacgcgcctgaatgcgatggggatgccttctatcgccatgtggatgcagtgcgggttggttactgtcttcatcctgctggtttcgtttggtggcggtaccgcatcggcgttctttaacaagctgacgctgatggcgaacgtgtctatgacgcttccttacctgttcctcgcgctggctttcccgttctttaaagcacgtcaggatctcgacagaccgtttgtgattttcaaaacgcatttgtcggcaatgattgcgacagtggttgtcgtactggtggtgacatttgcgaacgtcttcaccatcattcaacctgtggttgaagccggagactgggacagcacattgtggatgattggcggccctgtcttcttctcgctgttagcgatggcgatttaccagaactattgcagtcgcatggcgaataaacctgagttagctctcgactgatcatatgaaatcctgcaactcatcgtctctccggcgatgagttgtcaggaagtaatgcgtatggatgatactctccagggccggtgataactgaagatgatgttaagctgctaaatgagccacgttgacatcatttggcagcttcatgcattacaaacttcccgcctgacgacctttgcccgcagaagttaatgttctccccgtttgcttaccgttgaggctttccagacgcatctggaagggcgggaatggcatatcgataccgtgggcgtggaagcctgccagaatcagctggtggatctcatggcgtagcggcatacggtgacccatctcagcggcgtaaatacgcagctcgaaaatctgaatcccctgttgcagatccaccaggaagacttccggtgccgggttgtcgatcaccagcgagcagcgacgcgctgcggtgagcaggatttccgtcacttcttcgctattggcatcggcaggggccggtatcgtcaacaccacgcgcgtgaccgagtcagagagcgaccagttgataaactgctcggtaataaacgccttgttcggcacgattatctctttacggtcccagtcgctgatggtggtggcgcgggtgttaattttcgtcacgctaccggtaagatcgcggatcgttaccgtatcgccaatgcgaatcggtttttcgaacaggataatcaggccagagataaagttggcgaaaatctcctgcaaaccaaaaccgagaccaacaccgagcgcggcaaccagccactgcaatttcgaccactcaataccaatcatcgagaagccgaccagcccgccaatcagcatcagcagatatttggtgatggtggtgatggcgtagcccgtacccggcgttaaatccaggtgctgcaaaatcgccagttccagcagcgcgggcaggttgcgcaccagctgcgtggtgatgataaacaccagaatggcaatcagcaccgcaccgagggtaattggctccagactttctacgccctgtaccgtggaggtgacatcccacagcgaaatattttcgaggaagccgaaagcggaatggatttctgaccacagcacaatgacagaaagcagggcgatcaacatcaaaattgagcgcaccagccgcaaggattgcgcactgatggcatcgagatcgacttcgctttcatcgacttcaattgccccttccgggctactgtgatgatgcgcttcctcttcgccacgcgcgcgttgcgctaacatctctgcccggcgatgcttcgcccggtcaaacgccagcctgcgacgctggatcagcatccagcggcggataacgtgataaaccaccagtagcaggaaccagatggcaaccgaggtttcaagcctcgctaacagtgcctgcgccgttgccagataacccaccgctgacgccagaatggcaaccagtggtgcgccaatcatcatgttccacagcatatggttggtaatgttgtcgccgctgccctctttgttgaggtacagcgggatcccggcctttttcaggctgagggtgaccaccgccagcgcaccgcaaatgaggataaagcaaagccgtcccagcgaaccggagaattcacggtcgtcgaggttatcgaacatcatcagcgccataatcagcggcacaataagcccgatgctcatcaggtagtagcgcatcccacgggaaacacgttcgcgcggccagccaaaatgagcgataaacaagccgttcgggcgggcaaaggtggcgcaaatcatcactacccacagcagcggcacggtggccgttacgccatcgccaatcgcgaccgccagcggataaggccacgcctcgcgcaagccgtaacccagcgtcatccacagcaccggcagcggtgacgcgacgagaatcgaccagaaaagagtgcgcaacgtcagccagaagtgatcctgagtcactttgccgactttcgccgccgaacgttcaagaaaacgggtgaaatagcggcgcgagtaaatactgcaaccgaccagaatcaacgcgccaaacagcggcaaaatcgtctctttgctggtcagcatcatcacactggctttgcccaactgactgaaggtgtccagcgaaatgagacgacgcagatcctgggcgatttccagtggccaggcgatggtcatcgggcgcacgtcagaggtccagaacagatagcgatgcgtcgcttcattcacctctttcagcgcatcctcaagttgcccgttggagactttcagcttggtcagttccagcagtagcgtgtcgccaccctgcaacaatgagttcagcaactcacgctgagtgcgtagctgtgcttccagaatacggttttgctcggcggtcagcggctgaccgtcggcctgatgaatttgccgtagcagcggctgtttattaagcagatcctcataacgtaaccgttgcacacgcaactgcgccatttcggtatcaagctgttgtggtttcggcatttccggcagccgtgccacctgcgcccgcaacgcttcgccgagcaggttggacgatcccagccattgcgactgttcacgcagcgtattcagcgcctgccgaacctgtaacgtctggctggtggcctggcgctgttgcgaggcaacgagatccatccgctgcgcctgttgattcagtgccgccgatagttcgcggttaattttgaattgcgcgacgatgtctttcggcaaatcggcgctgttttctgccagcaattcggtactttccagcgcccgctccgcctcaagctgacgttggctgttcaactgattacgtaaggcctgcaaatacgcatccagttgctggctctctttttccgccagctctgagcgtaagcgcgctaattcctgacggttattggcagacagctgcgccagttccagttcatcaacgagcgctttcaggcgtgcggagtcagactgcaacgcgaaattttgtgcctgattgagcggggtattgccagtaagcgttcccaggcggcgctcgatctcatttaactgacggcgggcgtcggtttgctgttgcggcagttgattcagcgaatcggcaatctcgcgggcgcgctcctgctcttgctgggcctgacggcttttatccagcaactggctgctgacctggagaatttcctgattcagcgcgtcggtagacattcccggcgacacgctgcgcggctcgtcacgcatgttgtttaattgtgcgcgcagagtagcggagagtttcggataattatcgataacttgctgatattgtttgatgcgctcaagggaaccttttcgttcctcaagcgcatttaaggcagactggagcgcctctacgacttccggctgtgcgggtttcgccgcttttgcctgctccagttcctgagtgatttgtttgctatcgggggccgtcgcggcgtacgccccccaactgaggcaccaggccatcagaaaagtgataatcaggcgcacgtcagcgtttcctttgatggattagacctggtcttttttatcgtcaaccaatgggctggcgtcgtgttctgcttcgatctcttcagcaggaagtggggcgggttcagcgtctggcgtaacaaaggtttcggtagatactgccagcggctggccaattttcgtgacagacaggctttccagttgctcaaccagattcactttacccggtgcaaacaggttgataacggtagagccgagtttaaagcggcccatttcctggcctttcagcagtgccacagaaccgtcgttttccccggcaggccaggtccagcgcttgatgataccttcgcgcggcggcgtaatggtgcccgcccagaccgtctcaatgctgcctacaatcgtcgccccgaccagaatctgcgccatcgggccaaattcggtatcgaacaggcaaatcacgcgttcgttacgggcaaacagattcggcacgttctgagcggtgagatggttaacggagaagagatcgcccggcacgtagatcatctcacgcagaataccgttgcacggcatgtgtacgcgatggtagtcacgcggggagaggtaagtggtcacaaacgtaccgttgcggaacaggtccgccatcagatagttgcctgccagcagggcttcgaggctgtagttgtggcctttggcttgcaggattttattttcttcgattttacccaactggctgataacgccatcggcaggcatgaccaggacattcggatcggtatcgattgggcgtacttcgtcacgcagcggacggacaaagaattcgttaaaggtgcggtagctggcggtgtccggcttttgcgcctctttcatgtcgaccttgtagtatttaacgaacagatcgataaccagttttgtcagccatcctgcccgcttgcttgcgccccaacccgccaggcgagtaagccatagtttcggcagaatgtactgtagcgaaagtttaaatgaatttaacaaggtagcctccaggccattgttttgtcgttcctgatccggccaacatgccggatcctgaaaaaaaggggacgattctaacgacggttagcttaattgtcagtcatccgtatcagaaaagtttttacgcgtttttacctgcgccatgctttccagaatacggtgatagttttcgaaacgggtttccgcgattttcccttcctcaaccgcttcccggatagcgcagcccggatcggtatcgtgtttgcaatcgcgatatttacacagacctaaatagtcatggaattcgacaaagccctgagtgatttgttccggctccaggtgccagaggccgaactcacgcacaccaggggaatcaatcacatcaccgccgtgcgggaagtgatacagccgagcggcggtcgtggtgtgctgaccgagccccgagttgtcagagacatcgttggtcaggatctctttttgcagccccagcaacgcattcagcaggctggatttgccgacgccagactgcccggcaaaaatgctgatgcgcccggtcaacgcctcttccagcggttttagcccatcctgagtatggctggaaaccatcaatacgcgataaccgatattgcggtagatatccatctgctcgttgacgaacgccatgccttcgtcgtccagcaggtctatcttgttgagcacaataatcggctcaatctgcaaggtttcgcaggccaccaggtaacggtcgataatattgagcgacagctccggcaaaatggcggagacaatgacaatctggtcgatgttggcggcaataggttttacgccgtcgtagaaatccggacgcgtcaacaccgaggtacgctcatgcaccgcttccacgatccctttgacatttacgccttccgccgccggtttacccggacgccagactacgcggtcgccggttaccagcgaacggatggtacggcgaatattgcagcggtgaacgtcgccatcggcggattccacatcagcgtgcataccaaagcggctgatgacgataccttcatcaggctcgccaaacagattgtcgtcgtagtcgggcttctccttagacgttttaagacgacgctggtgattggcgttcacgcggcgctgctggcctttggagagtttatttttactcaatcgtacagactcctggtcgcccctgatgggcaaaacatctatgatacacgcaattgtggatcaatatagtccctgtgaatgggtggaaaatagcatgagtgccaatgaaaacaacctgatttggatcgatcttgagatgaccggtctggatcccgagcgcgatcgcattattgagattgccacgctggtgaccgatgccaacctgaatattctggcagaagggccgaccattgcagtacaccagtctgatgaacagctggcgctgatggatgactggaacgtgcgcacccataccgccagcgggctggtagagcgcgtgaaagcgagcacgatgggcgatcgggaagctgaactggcaacgctcgaatttttaaaacagtgggtgcctgcgggaaaatcgccgatttgcggtaacagcatcggtcaggaccgtcgtttcctgtttaaatacatgccggagctggaagcctacttccactaccgttatctcgatgtcagcaccctgaaagagctggcgcgccgctggaagccggaaattctggatggttttaccaagcaggggacgcatcaggcgatggatgatatccgtgaatcggtggcggagctggcttactaccgcgagcattttatcaagctgtaaaatttttcctggtcacgtaagcgccggaatccacttgcggcggcgtgattttgacgctaaattgaacgtcttgctgataatttcagcacttgagataaaaacgcaaaaaaaacttttttggggggttgcagagggaaagatttctcgtataatgcgcctcccgtaacgacgcagaaatgcgaaaattacgaaagcaaaattaagtagtacgcgggaatagctcagttggtagagcacgaccttgccaaggtcggggtcgcgagttcgagtctcgtttcccgctccaaaatttgaaaagtgctgtaaagcacagaccacccaagcgggaatagctcagttggtagagcacgaccttgccaaggtcggggtcgcgagttcgagtctcgtttcccgctccaaaatttgaaagtgctgtaaggcacagaccacccaagcgggaatagctcagttggtagagcacgaccttgccaaggtcggggtcgcgagttcgagtctcgtttcccgctccaaattcttctctcaataaaatatccacagcgatgcgttattgctggttttcgttgtctctgacaaactcttgtaaacagagttatccacagcctcaggctgtaatcttaatttcaaagaaacttcgcacggtgaatagtatttttttaacctattgatagataagttaaaaattaagattccgttttgtcgagtcgatcacttgacgattttattcgtcttgaattgcaatgcgtttttatttttattcacaagctgtggatgaatcaggcgtcacgcggtaaccctttttcaatcacccgaaccagacgctgttttttcggcaattgcacttcgactatgcacgcatttcgtctctctatttgctgcgcaatcgcccacgctatgtgctcatcgagaagtgggtgctcacctttacgactttccagcgctgtcaaaatcgtttcatcccaaggggcattgcctaatgctacggcgatattacgcagccaacgcaggtgaccaatacgacgaatcgccgatccttccgtgacttttaaaaacttctcttcgctccaggcgaataactcaatgagttccggtgcgtgtagcggcttacgcgggctgaaatcctcttctgtggtgagttgtgaatagcgattccacgggcagataagctggcagtcatcgcaaccgtaaatacggtttcccattaacggtcgcaactcttccgggatcgccccttcaagttcgatggtgagataagagatacagcggcgagcatcgacggtatatggctcgacgatggcaccggtcgggcaaatcgtcatacaggccacgcatttaccgcatccttcctcgactggttgatccacgggcagcggaatatcgaccagcaattcgcctaaaaagaagaaagaaccggcctcgcgattgaggataagtgagtgcttacctgtccagccgagcccagctttttcagctaacgggcgctcgagaataggcgcagaatcgacaaacggtctaaaattcagcgaaacacaatgttgctgaatcatctcgcccagctttttgagtcggttgcgcagaagtttgtgatagtcacggcccagcgcataacggctaacatagccgagtttggggtttttcagcgtgctggcaaatgcggcgttagcaggaaggtaattcatccgcacgctgatcacgcgcagcgtaccgggcaataactcatgggggcgagcgcgcagcataccgtgacgtgccatccagtccatttcgccgtggtattgtttgtccagccatgcttgcagtttgggctcggactcgctgagatcggtatcggtaatacctacctgctgaaagcccagttccagcccccactgtttaattttttgcgctaactgattgagatcgaggggctctgacatgacggaccatacaatgaagaaaaaccccgtaagtataccacacaccgtctggcacgccgacgatatccgccgcggagaacgtgaggcggcagatgcgctggggcttacactctatgagctgatgcttcgcgctggcgaagccgcattccaggtgtgtcgttcggcgtatcctgacgcccgccattggctggtgctgtgcggtcatggtaataacggcggcgatggctacgtggtcgcgcggctggccacagcggtcggcattgaggtcacgctgctggcccaggagagcgacaaaccgttgccggaagaggccgcgctggcacgcgaagcatggttaaacgcgggaggcgagatccatgcttcgaatattgtctggcccgaatcggtagatctgattgttgatgcgctgctcggtaccggcttgcagcaagcgccccgcgaatccattagccagttaatcgaccacgctaattcccatcctgcgccgattgcggcggttgatatcccttccggcctgctggctgaaaccggcgctacgccaggcgcagtgatcaacgccgatcacaccatcacttttattgcgctgaaaccaggcttgctcactggaaaagcgcgggatgttaccggacaactgcattttgactcactggggctggatagttggctggcaggtcaggagacgaaaattcagcggttttcggcagaacaactttctcactggctaaaaccgcgtcgcccgacttcgcataaaggcgatcacgggcggctggtaattatcggtggcgatcacggcacggcgggggctattcgtatgacgggggaagcggcgctacgtgctggtgctggtttagtccgagtactgacccgcagtgaaaacattgcgccgctgctgactgcacgaccggaattgatggtgcatgaactgacgatggactctcttaccgaaagcctggaatgggccgatgtggtggtgattggtcccggtctgggccagcaagagtgggggaaaaaagcactgcaaaaagttgagaattttcgcaaaccgatgttgtgggatgccgatgcattgaacctgctggcaatcaatcccgataagcgtcacaatcgcgtgatcacgccgcatcctggcgaggccgcacggttattaggctgttccgtcgctgaaattgaaagtgaccgcttacattgcgccaaacgtctggtacaacgttatggcggcgtagcggtgctgaaaggtgccggaaccgtggtcgccgcccatcctgacgctttaggcattattgatgccggaaatgcaggcatggcgagcggcggcatgggcgatgtgctctctggtattattggcgcattgcttgggcaaaaactgtcgccgtatgatgccgcctgtgcgggctgtgtcgcgcacggtgctgcagctgacgtactggcggcgcgttttggaacgcgcgggatgctggcaaccgatctcttttccacgctacagcgtattgttaacccggaagtgactgataaaaaccatgatgaatcgagtaattccgctccctgatgagcaggcaacattagacctgggcgagcgggtagcgaaagcctgcgatggcgcaaccgtaatctatctgtatggcgatttaggcgcaggtaaaaccacctttagccggggctttttacaagctctgggtcatcagggtaatgtcaaaagccccacttatacgctggtcgaaccctatacgctcgacaatttaatggtttatcactttgatttgtaccgccttgccgatcccgaggagctggagtttatggggattcgcgattattttgccaacgatgccatctgcctggtggagtggccacaacaaggtactggtgttcttcctgacccggatgtcgaaatacacattgattatcaggcacaaggccgtgaggcgcgcgtgagtgcggtttcctctgcgggtgaattgttgctggcgcgtttagccggttaacctttgaaaggtggcgggatgatgtatcgcatcagaaattggttggtagcgacgctgctgctgctgtgcacgccggtgggtgccgcgacgctctctgatattcaggtttctaacggtaatcaacaggcgcggataacgttgagttttattggcgatcctgattatgcgtttagccatcaaagcaaacgcaccgtggcgctcgatatcaaacaaacgggcgtgattcagggactgccgttgttgttcagcggcaataatctggtgaaggcgattcgctctggaacgcctaaagatgcacaaacgctacggctggtggtcgatcttaccgaaaacggtaaaaccgaagcggtgaagcggcagaatggcagcaattacactgtcgtctttacgattaacgccgatgcgccgccacctcctcctccgccgcccgtggttgcgaaacgcgttgaaacgcctgcggttgtcgcaccgcgcgtcagcgaaccggcgcgcaatccgtttaaaacggaaagtaaccgcactacgggtgttatcagcagtaatacggtaacgcgtccggcagcgcgcgcgacggctaacactggcgataaaattatcatcgctattgatgccggacacggcggtcaggaccctggcgctatcggccccggtggtacgcgggagaaaaatgtcaccatcgccatcgcgcgtaaattgcgtactttgctcaatgacgatccgatgtttaagggcgttttaacccgtgacggggattactttatctcggtgatggggcgcagtgatgtggcacgtaagcaaaacgccaatttcctcgtgtcgattcacgctgatgccgcaccgaaccgcagtgcgactggcgcttccgtatgggtgctctctaaccgtcgcgccaacagcgaaatggccagctggctggagcagcacgagaaacagtcggagctgctgggtggggcgggtgatgtgctggcgaacagtcagtctgacccctatttaagccaggcggtgctggatttacagttcggtcattcccaacgggtagggtatgatgtagcgaccagtatgatcagtcagttgcaacgcattggcgaaatacataaacgccgaccagaacacgcgagtctcggcgttctgcgttcgccggatatcccatcagtactggtcgaaaccggttttatcagcaacaacagcgaagaacgtttgctggcgagcgacgattaccaacaacagctggcagaagccatttacaaaggcctgcgcaattatttccttgcgcatccgatgcaatctgcgccgcagggggcaacggcacaaacggccagtacggtgacgacgccagatcgcacgctgccaaactaaggacgattgatgccaattcaggtcttaccgccacaactggcgaaccagattgccgcaggtgaggtggtcgagcgacctgcgtcggtagtcaaagaactggtggaaaacagcctcgatgcaggtgcgacacgtatcgatattgatatcgaacgcggtggggcgaaacttatccgcattcgtgataacggctgcggtatcaaaaaagacgagctggcgctggcgctggcgcgtcatgccaccagtaaaatcgcctctctggacgatctcgaagccattatcagcctgggctttcgcggtgaggcgctggcgagtatcagttcggtttcccgcctgacgctcacttcacgcaccgcagaacagcaggaagcctggcaggcctatgccgaagggcgcgatatgaacgtgacggtaaaaccggcggcgcatcctgtggggacgacgctggaggtgctggatctgttctacaacaccccggcgcggcgcaaattcctgcgcaccgagaaaaccgaatttaaccacattgatgagatcatccgccgcattgcgctggcgcgtttcgacgtcacgatcaacctgtcgcataacggtaaaattgtgcgtcagtaccgcgcagtgccggaaggcgggcaaaaagaacggcgcttaggcgcgatttgcggcaccgcttttcttgaacaagcgctggcgattgaatggcaacacggcgatctcacgctacgcggctgggtggccgatccaaatcacaccacgcccgcactggcagaaattcagtattgctacgtgaacggtcgcatgatgcgcgatcgcctgatcaatcacgcgatccgccaggcctgcgaagacaaactgggggccgatcagcaaccggcatttgtgctgtatctggagatcgatccgcatcaggtggacgtcaacgtgcaccccgccaaacacgaagtgcgtttccatcagtcgcgtctggtgcatgattttatctatcagggcgtgctgagcgtgctacaacagcaactggaaacgccgctaccgctggacgatgaaccccaacctgcaccgcgttccattccggaaaaccgcgtggcggcggggcgcaatcactttgcagaaccggcagctcgtgagccggtagctccgcgctacactcctgcgccagcatcaggcagtcgtccggctgccccctggccgaatgcgcagccaggctaccagaaacagcaaggtgaagtgtatcgccagcttttgcaaacgcccgcgccgatgcaaaaaccaaaagcgccggaaccgcaggaacctgcacttgcggcgaacagtcagagttttggtcgggtactgactatcgtccattccgactgtgcgttgctggagcgcgatggcaacatttcacttttatccttgccagtggcagaacgttggctacgtcaggcacaattgacgccgggtgaagcgcccgtttgcgcccagccgctgctgattccgttgcggctaaaagtttctgccgaagaaaaatcggcattagaaaaagcgcagtctgccctggcggaattgggtattgatttccagtcagatgcacagcatgtgaccatcagggccgtgcctttacccttacgccaacaaaatttacaaatcttgattcctgaactgataggctacctggcgaagcagtccgtattcgaacctggcaatattgcgcagtggattgcacgaaatctgatgagcgaacatgcgcagtggtcaatggcacaggccataaccctgctggcggacgtggaacggttatgtccgcaacttgtgaaaacgccgccgggtggtctgttacaatctgttgatttacatccggcgataaaagccctgaaagatgagtgatatcagtaaggcgagcctgcctaaggcgatttttttgatggggccgacggcctccggtaaaacggcgttagccattgagctgcgtaaaattttaccagtagagttgataagcgttgattctgcccttatttacaaagggatggatatcgggacggcgaagccgaacgctgaagagttactcgccgcgccgcaccgattgctggatattcgcgatccgtcgcaggcttactcggctgctgattttcgccgcgatgcgctggcggaaatggccgatatcaccgcggcggggcggatcccactgttagtgggcggtacgatgttgtatttcaaggcattgctggaagggttgtcgccgctaccgtcggcagacccggaagtgcgggccagaattgagcaacaggcggcagagcaaggttgggagtcattgcatcgtcaacttcaggaggtagatccggttgcggcagcaaggattcatccaaatgatccacaaaggctttcccgggcactggaagtttttttcatttcgggtaaaactttaacggaactgacgcaaacgtcaggagacgctctaccgtatcaggtgcatcagttcgccatcgccccggcgagccgtgaactgctccatcaacgcattgagcagcgttttcatcagatgttggcttcaggttttgaagcagaagtccgggcgctttttgcccgaggagatttgcatacggacttgccttccattcgttgcgtgggttatcgccagatgtggtcttaccttgaaggcgaaatctcatacgatgaaatggtttatcgaggtgtttgcgccacgagacagttggcgaagcggcagataacctggctgcgtggttgggaaggggttcactggcttgacagtgaaaaaccagaacaggcgcgtgacgaagtattacaggttgttggtgctatcgcaggctgaatgtgtacaattgagacgtatcgtgcgcaattttttcagaatcgaaaggttcaaagtacaaataagcatataaggaaaagagagaatggctaaggggcaatctttacaagatccgttcctgaacgcactgcgtcgggaacgtgttccagtttctatttatttggtgaatggtattaagctgcaagggcaaatcgagtcttttgatcagttcgtgatcctgttgaaaaacacggtcagccagatggtttacaagcacgcgatttctactgttgtcccgtctcgtccggtttctcatcacagtaacaacgccggtggcggtaccagcagtaactaccatcatggtagcagcgcgcagaatacttccgcgcaacaggacagcgaagaaaccgaataaggtttcgggctgtttttttacacggggagccagcgatcctgcgttccccgctgatctatttagagggttatacgcttgtttgaccgttatgatgctggtgagcaggcggtactggtacacatctattttacgcaagacaaagatatggaagacctccaggagtttgaatctctggtctcttccgccggtgtcgaagcattgcaggtgattaccggtagccgtaaagcgccgcacccaaagtattttgtaggtgaaggtaaagcagttgaaattgcggaagctgtcaaagcgacgggtgcttcggtcgttctttttgaccatgccctgagcccggcgcaagagcgtaacctggagcgtttgtgcgagtgtcgtgttatcgaccgcaccggccttattttagatattttcgcccaacgtgcgcgtacccatgagggtaagttgcaggttgagctggcgcagctgcgccatctggctacgcgcctggtgcgtggctggacccaccttgaaagacagaaaggcgggataggtttgcgtggtccgggtgaaacccagctcgaaaccgaccgtcgtttgttgcgtaatcgcatcgtgcagatacagtcgcgcctggaaagagttgaaaagcagcgtgagcaggggcggcaatcgcgtatcaaagccgacgttcctactgtttcgctggtgggatataccaacgccggtaaatctacccttttcaatcgcatcaccgaagcgcgggtctacgcggcagaccagttgtttgccaccctcgacccgacgttgcggcgtattgacgttgcagatgtcggtgaaaccgtgttggcagataccgtagggtttattcgccacctgccgcacgatctggttgcagcatttaaagccacgttacaagagacgcggcaagccacattactgctgcacgtcattgatgcggcggatgtgcgtgtacaagaaaacatcgaagcggtgaatacggttcttgaagagatcgacgctcacgagatcccaaccctgctggtgatgaacaagatcgatatgctggaagatttcgaaccgcgtattgatcgggacgaagagaacaaaccgatccgtgtctggctttccgcacagaccggagcggggataccacagctttttcaggctttgacggagcggctttccggcgaggtggcgcagcatacattgcgtctgccaccgcaggaagggcgtctgagaagtcgtttttatcagcttcaggcaatagaaaaagagtggatggaggaggacggcagcgtaagtctgcaagttcgtatgccgatcgttgactggcgtcgcctctgtaaacaagaaccggcgttgatcgattacctgatctaacggcgtagcgtctgaagcgtggagtcatatcctctggcgtcgaaagacaacagggatcaccgcataacaaatatggagcacaaacatggcgtggaatcagcccggtaataacggacaagaccgcgacccgtggggaagcagcaaacctggcggcaactctgagggaaatggaaacaaaggcggtcgcgatcaagggccacctgatttagatgatatcttccgcaaactgagcaaaaagctcggtggtctgggcggcggtaaaggcaccggatctggcggtggcagttcatcgcaaggcccgcgcccgcagcttggcggtcgtgtcgttaccatcgcagcggcagcgattgtcattatctgggcggccagtggtttctataccattaaagaagccgaacgcggcgtggtaacacgctttggtaaattcagccatctggttgagccgggtctgaactggaaaccgacgtttatcgacgaagtcaaaccggtaaacgtggaagccgtgcgtgaactggccgcttccggtgtgatgttgacgtcggacgagaacgtagtgcgcgttgagatgaacgtgcagtaccgcgttaccaatccggaaaaatatctgtatagcgtgaccagcccggatgacagtctgcgtcaggctaccgacagcgccctgcgcggggttatcggtaaatacaccatggaccgcattctgacggaaggtcgtaccgtgattcgtagcgatactcagcgcgaactggaagagactatccgtccgtatgacatgggcatcactctgctggacgtcaacttccaggctgctcgtccgccggaagaagtaaaagcggcgtttgacgatgcgattgccgcgcgtgaaaacgaacagcaatacattcgtgaagcagaagcgtataccaacgaagttcagccgcgtgcgaacggtcaggcgcaacgtatcctcgaagaggcgcgtgcgtacaaggcccagaccatcctggaagctcagggtgaagtggcgcgctttgctaaacttctgccggaatataaagccgcgccggaaattactcgcgagcgtctgtatatcgagacgatggaaaaagtgttgggtaacacccgcaaagtgctggttaacgataaaggtggcaacctgatggttctgccgttagaccagatgctgaaaggtggtaacgcccctgcggcgaagagcgataacggtgccagcaatctgctgcgtttgccgccagcctcttcctccacaaccagtggagcaagcaacacgtcgtccaccagtcagggcgatattatggaccaacgccgcgccaacgcgcagcgtaacgactaccagcgtcagggggaataacgatgcgtaagtcagttatcgcgattatcatcatcgtgctggtagtgctttacatgtctgtctttgtcgtcaaagaaggtgagcgcggtattacgctgcgttttggtaaggtactgcgtgacgatgacaacaaacctctggtttatgagccgggtctgcatttcaagataccgttcattgaaacggtgaaaatgctcgacgcacgtattcagaccatggacaaccaggccgaccgctttgtgaccaaagagaagaaagacctgatcgtcgactcttacatcaaatggcgcatcagcgatttcagccgttactacctggcaacgggtggtggcgacatttcgcaagcggaagtgctgttgaaacgtaagttctctgaccgtctgcgttctgaaattggtcgcctggacgtgaaagacatcgtcaccgattcccgtggtcgtctgaccctcgaagtacgtgacgcgctgaactccggttctgcgggtacagaagatgaagttactaccccggcagcagataacgccattgccgaagcggcagagcgcgtaacggctgagacgaagggcaaagttccggtcatcaacccgaacagtatggcggcgctgggtattgaagttgtcgatgtgcgtatcaagcagatcaacctgccgaccgaagtgtctgaagcgatctacaaccgtatgcgcgccgagcgtgaagcggtagcgcgtcgtcaccgttcacaaggtcaggaagaagcggaaaaactgcgcgcgactgccgactatgaagtgaccagaacgctggcagaagctgagcgtcagggccgcatcatgcgtggtgaaggcgatgccgaagcagccaaactgtttgctgatgcattcagtaaagatccggacttctacgcattcatccgtagcctgcgtgcttatgagaacagcttctctggcaatcaggacgtgatggtcatgagcccggatagcgatttcttccgctacatgaagacgccgacttccgcaacgcgttaatataacgactgcggtacaggtcaataaagccaccgcatcctcagggatgtcggtggttttctttttctataaggataatgaatgaattcgacaatctggctggcgcttgccctggttttggtactggaaggtttagggccgatgctttacccgaaggcatggaagaagatgatctctgcgatgaccaatttgcccgataatattttacgtcgttttggcggtggacttgtggttgcgggcgttgtggtctactacatgttgaggaaaacgattggctgaacaaaaaacagactgatcgaggtcatttttgagtgcaaaaagtgctgtaactctgaaaaagcgatggtagaatccatttttaagcaaacggtgattttgaaaaatgggtaacaacgtcgtcgtactgggcacccaatggggtgacgaaggtaaaggtaagatcgtcgatcttctgactgaacgggctaaatatgttgtacgctaccagggcggtcacaacgcaggccatactctcgtaatcaacggtgaaaaaaccgttctccatcttattccatcaggtattctccgcgagaatgtaaccagcatcatcggtaacggtgttgtgctgtctccggccgcgctgatgaaagagatgaaagaactggaagaccgtggcatccccgttcgtgagcgtctgctgctgtctgaagcatgtccgctgatccttgattatcacgttgcgctggataacgcgcgtgagaaagcgcgtggcgcgaaagcgatcggcaccaccggtcgtggtatcgggcctgcttatgaagataaagtagcacgtcgcggtctgcgtgttggcgaccttttcgacaaagaaaccttcgctgaaaaactgaaagaagtgatggaatatcacaacttccagttggttaactactacaaagctgaagcggttgattaccagaaagttctggatgatacgatggctgttgccgacatcctgacttctatggtggttgacgtttctgacctgctcgaccaggcgcgtcagcgtggcgatttcgtcatgtttgaaggtgcgcagggtacgctgctggatatcgaccacggtacttatccgtacgtaacttcttccaacaccactgctggtggcgtggcgaccggttccggcctgggcccgcgttatgttgattacgttctgggtatcctcaaagcttactccactcgtgtaggtgcaggtccgttcccgaccgaactgtttgatgaaactggcgagttcctctgcaagcagggtaacgaattcggcgcaactacggggcgtcgtcgtcgtaccggctggctggacaccgttgccgttcgtcgtgcggtacagctgaactccctgtctggcttctgcctgactaaactggacgttctggatggcctgaaagaggttaaactctgcgtggcttaccgtatgccggatggtcgcgaagtgactaccactccgctggcagctgacgactggaaaggtgtagagccgatttacgaaaccatgccgggctggtctgaatccaccttcggcgtgaaagatcgtagcggtctgccgcaggcggcgctgaactacatcaagcgtattgaagagctgactggtgtgccgatcgatatcatctctaccggtccggatcgtactgaaaccatgattctgcgcgatccgttcgacgcgtaattctggtacgcctggcagatattttgcctgccgggctaacagtgtgatacattgctgtgtcggttaagccattacgctatccgacacagtgttaaatcctcgcttttttccttccccgaactgaaataaattagcgacacagcttgtggctggtttatcatcaatataaatgtattttttcccgatttcccttttgaggttgatgtgcagttaacgagtttcactgattacggattacgtgcgctgatctacatggcgtcattgccagaagggcggatgaccagtatttctgaagtgactgacgtctacggcgtctcccgtaatcatatggtcaaaataatcaatcaacttagtcgtgccggctacgtgactgctgttcgtggaaaaaatggcggcattcgcctgggtaaatcggcgagtgcgatacgtattggtgatgtggtgcgcgagctggagcccttatcgctggtgaattgcagcagtgagttttgccacattacacctgcctgtcggttgaaacaggcgctttctaaggccgtgcaaagttttcttacggaactggataactacacgcttgccgatttggttgaagagaatcaaccgctttataaattattgctggtggagtgacgaaaatcttcatcagagatgacaacggaggaaccgagatgtcacaagatcctttccaggaacgcgaagctgaaaaatacgcgaatcccatccctagtcgggaatttatcctcgaacatttaaccaaacgtgaaaaaccggccagccgtgatgagctggcggtagaactgcacattgaaggcgaagagcagcttgaaggcctgcgtcgccgcctgcgcgcgatggagcgcgatggtcaactggtcttcactcgtcgtcagtgctatgcgctgccggaacgcctcgacctggtgaaaggtaccgttattggccaccgtgatggctacggctttctgcgggttgaagggcgtaaagatgatttgtatctctccagcgagcagatgaaaacctgcattcatggcgatcaggtgctggcgcagccgctgggcgctgaccgtaaaggtcgtcgtgaagcgcgtattgtccgcgtactggtgccaaaaaccagccagattgttggtcgctactttactgaagcgggcgtcggctttgtggttcctgacgatagccgtctgagcttcgatatcttaatcccgcccgatcagatcatgggcgcgcggatgggctttgtggtcgtagtcgaactgactcagcgtccgactcgccgcaccaaagcggtgggtaaaatcgtcgaagtgctgggcgacaatatgggcaccggcatggcggttgatatcgctctgcgtacccatgaaattccgtacatctggccgcaggctgttgagcaacaggttgccgggctgaaagaagaagtgccggaagaagcaaaagcgggccgtgttgatctgcgcgatttaccgctggtcaccattgatggcgaagacgcccgtgactttgacgatgcagtttactgcgagaaaaaacgcggcggcggctggcgtttatgggtcgcgattgccgacgtcagctactatgtgcgtccgccaacgccgctggacagagaagcgcgtaaccgtggcacgtcggtgtacttcccttcgcaggttatcccgatgctgccggaagtgctctctaacggcctgtgttcgctcaacccgcaggtagaccgcctgtgtatggtgtgcgagatgacggtttcgtcgaaaggccgcctgacgggctacaaattctacgaagcggtgatgagctctcacgcgcgtctgacctacaccaaagtctggcatattctgcagggcgatcaggatctgcgcgagcagtacgccccgctggttaagcatctcgaagagttgcataacctctataaagtgctggataaagcccgtgaagaacgcggtgggatctcatttgagagcgaagaagcgaagttcattttcaacgctgaacgccgtattgaacgtatcgaacagacccagcgtaacgacgcgcacaaattaattgaagagtgcatgattctggcgaatatctcggcggcgcgtttcgttgagaaagcgaaagaaccggcactgttccgtattcacgacaagccgagcaccgaagcgattacctctttccgttcagtgctggcggagctggggctggagctgccgggtggtaacaagccggaaccgcgtgactacgcggaactgctggagtcggttgccgaccgtcctgatgcagaaatgctgcaaaccatgctgctacgctcgatgaaacaggcgatttacgatccagaaaaccgtggtcacttcggtctggcattgcagtcctatgcgcactttacttcgccgattcgtcgttatcctgacctgacgctgcaccgcgccattaaatatctgctggcgaaagagcaggggcatcagggcaacaccactgaaaccggcggctaccattattcgatggaagagatgttgcaactgggtcagcactgttcgatggcggaacgtcgtgccgacgaagcaacgcgcgatgtcgctgactggctgaagtgtgacttcatgctcgaccaggtaggtaacgtctttaaaggcgtaatttccagcgtcactggctttggcttcttcgtccgtctggacgacttgttcattgatggtctggtccatgtctcttcgctggacaatgactactatcgctttgaccaggtagggcaacgcctgatgggggaatccagcggccagacttatcgcctgggcgatcgcgtggaagttcgagtcgaagcggttaatatggacgagcgcaaaatcgactttagtctgatctccagtgaacgcgcaccgcgcaacgtcggtaaaacggcgcgcgagaaagcgaaaaaaggcgatgcaggcaaaaaaggcggcaagcgtcgtcaggtcggtaaaaaggtaaactttgagccagacagcgccttccgcggtgagaaaaaaacgaagccgaaagcggcgaagaaagacgcgagaaaagcgaaaaagccatcggcgaaaacgcagaaaatagccgcagcgaccaaagcgaagcgtgcggcgaagaaaaaagtggcagagtgatcaataccctctttaaaagaagagggttagattgctgacaaaatgcgctttgttcatgccggatgcggcgtgaacgccttatccggcctacataatcacgcaaattcaatatattgcagagatcatgtaggccggataaacgtagtgcatcaggcaaaacgtaaacaacgagtacattaatgagcgaaatgatttacggcatccacgcagtgcaggccctgctggagcgcgcccctgaacgttttcaggaagtctttattttaaaaggccgtgaagataaacgtctgttaccgctgattcacgcccttgagtctcagggcgtggttatccagttggcaaaccgccaatatctcgacgagaaaagcgacggtgccgtgcatcagggcattatcgcccgcgtgaagccaggacgtcagtatcaggaaaacgatctgccggatctgatcgcttcgctcgatcaaccgttcctgctgatcctcgacggtgtaaccgatccgcacaacctcggcgcgtgcctgcgtagcgcggacgctgctggcgttcacgcggtgattgtgccgaaagatcgctccgcacagctcaacgctacggcgaaaaaagtagcctgcggcgcggcagaaagcgttccactgattcgggtgactaaccttgcgcgcaccatgcgtatgttgcaggaagagaatatctggatcgtcggtacggcaggcgaggcggatcatacactctatcagagcaaaatgaccggacgcctggcgctggtgatgggcgcggaaggtgaaggtatgcgtcgcctgacccgtgaacattgcgatgagttgatcagcatcccaatggcaggaagtgtttcttccctgaacgtttcggttgcaaccggaatttgcttatttgaagcggttcgtcagcgcagctagttcgtctgaattatgaaaagccatccagatttggatggtttttttttgtctatagctggtaagataattacgtactgcaaatattcattttattaatatttaaactaaatctatatggaataatatatgacatggaatccgttggcgctggcgacggcgctgcaaactgtacctgaacaaaatattgatgtgacaaatagcgagagcgcattaattattaaaatgaatgattatggcgatttgcaaatcaatattctttttacttcccgccaaatgattatcgaaacctttatttgtccggtaagtagtatcagcaatccagatgaatttaataccttcttattaagaaatcagaagatgatgccgttgtcatcggtaggaatctccagcgtgcaacaggaagagtattacattgttttcggggcgttatcgcttaaatcttctcttgaagatatcctgcttgagataacctcgctggtagataacgcattggatctggctgaaattacagaagaatattcacactaattacaaggacgggtatttatgggaattttaaaaagtttatttacgctggggaaatcgtttatctcccaggcggaagaatccattgaagaaacccagggcgtgcgcatgctggaacagcatattcgtgacgctaaagctgaactcgttaaagccggaaaatctcgcgttgatctgctggcgcgggtgaaattaagtcacgataagctgaaagatttacgtgagcgcaaagccagtctggaagcccgtgcgctggaagcgttaagcaagaacgttaatccgtcgttgattaacgaagttgctgaagaaatcgcgcgccttgagaatctcattaccgctgaagagcaagtgttgtcgaatctggaagtctcccgtgatggcgtggaaaaagcagttacagcgacagcgcagcgtatcgctcagtttgagcagcaaatggaagtcgttaaagccactgaagccatgcagcgtgcacaacaggctgtaacaacctctaccgttggcgcatcttccagcgtttcgacagcggcagaatccttaaaacgcctgcaaacgcgtcaggccgaacgtcaggctcgcctggatgctgctgcacagttggaaaaagtcgcagacggtcgcgatcttgatgaaaagctggcggaagccggaattggcggtagcaataaaagtagcgcccaggatgtattagcaagactgcaacgccaacagggcgagtaatttttttgccagcctcgctaaaaggctggcaactattttaaggataaaatatgtctggttttttccagcgtctgtttggcaaggataataagcctgctatcgctcgcggtccgctgggacttcatctcaatagtggctttacgctcgacacgttagcgtttcgtttgctggaagatgaattgctgattgcgctgccgggtgaggaatttacggtagccgctgtcagccacatcgatctgggcggcggtagtcagattttccgctactacacttcaggcgatgaatttctgcaaatcaataccaccggcggcgaagatattgatgacattgatgatatcaagctctttgtctatgaagagagctacggtatcagtaaagagagtcactggcgcgaggcgatcaacgccaaagtgatgggggcaatgatcttaaactggcaggaaaaacgctggcagcgattttttaacagcgaagaaccgggaaatatcgaacccgtctacatgctggaaaaagtagaaaatcaaaaccatgccaaatgggaggtccataattttaccatgggctaccagcggcaagtaaccgaagatacttacgaatatttgctgttaaatggtgaggaatcttttaacgctctcggcgagccagagtggttattttcgcgcgcgttgggtgtcgatatcccgctgacatcacttcatattattggttaattacaaggacgtttacaatgcatatactggattcacttcttgcctttagcgcctatttttttattggcgtggctatggtgattatttttctttttatctattctaaaattacaccgcacaacgaatggcagttaatcaaaaacaataataccgcggcttcactggcgttcagtggtacattgttaggttacgttatcccattatccagtgcggcaatcaatgcggtgagtattccagactatttcgcctggggcgggattgcactggtgattcagttactcgtttttgctggtgtcagactttatatgcccgcattaagcgaaaaaattattaatcacaataccgcagcaggaatgtttatgggaaccgccgcgctggctggcggtatttttaacgcagcttgtatgacatggtaatggacgatcatggccagaaaacgcaaatcaagaaataacagtaaaattggtcacggagcgatcagtcgcattggaagaccgcataatccttttgagccgcgccgcaatcgctacgcacaaaaatacttaacgttggtgctaatgggcggtgccgtttttttaatagtcaaaggatggagtgaaagtagcgatgtcgataacgacggcgacggaacgttttactcgacagtgcaggattgtattgatgacggtaataatgccgacatttgcgcgcgtggctggaataacgccaaagcggcgttttatgccgatgttccgaagaatatgactcagcagaactgtcagtctaagtatgaaaattgttactacgacaacgttgaacagagttggatcccggtaatatctggatttttgttaagccgggttattcgtaaagatcgcgatgagccgtttgtttataacagcggcggttcctcttttgcttcgcgcccagtctggcgcagcacttctggtgattactcttggcgctccggttctggcaaaaaagagtcttactcttcgggcggctttaccaccaaaaaagcgtctaccgtttctcgcggcggctatggtcgttcttccagcgcccgtgggcattggggaggctaatcatgctgagacacaacgttcctgtgcgacgggatctggaccagatcgccgctgacaacggtttcgactttcatatcatcgacaatgaaatctattgggatgagagtcgggcttaccgttttactctgcgccagattgaagagcagatcgaaaaaccgactgcggaactgcatcagatgtgccttgaggtggtggatcgcgcggtaaaagatgaagagatcctgacgcaactggcgatcccgccgttgtactgggatgtgatcgccgaaagctggcgcgcacgcgatccttcgctgtatggccggatggattttgcctggtgtggcaatgcgccggtgaagctgctggagtacaacgccgatacgccgacctcgttgtatgagtcggcttatttccagtggttgtggctggaggatgcccggcgcagcggcattattccgcgtgatgccgatcagtacaatgccattcaggaacgcctgatttcacgctttagcgagctttatagccgggagccgttttatttctgctgctgtcaggacaccgatgaagacaggactaccgtgctgtacttgcaggactgcgcccagcaggcagggcaggagtcgcggtttatctacattgaagatctcggtttgggcgtcggcggtgtactgaccgatcttgatgataatgtcatccagcgtgcatttaagctgtatccgctggagtggatgatgcgtgacgataacggtccgctgctgtgcaagcgtcgcgagcaatgggtggagccgttatggaaaagtatcttgagtaataaagggctaatgccgctgctttggcgcttcttccctggtcatcctaaccttcttgcatcctggtttgagggtgaaaaatcgcagattgccgctggcgaaagctatgtgcgtaaaccgatctactcgcgcgaaggcggaaacgtcaccattttcgacggtcagaataacgtcgttgaccacgctgatggtgattacgccgatgaaccgatgatctaccaggcgtttcaacctctgccgcgatttggcgatagctacacactcatcggtagctggattgtcgatgatgaagcgtgcggaatggggatccgtgaagataacacactgatcaccaaagacacctcacgtttcgttccgcattacattgctggataagaatgttttagcaatctctttctgtcatgaatccatggcagtgaccatactaatggtgactgccattgatggagggagacacagtgcactggcaaactcacaccgtttttaatcaacctataccattaaataacagcaacttatacctgtctgatggcgcgctctgcgaagcggtaacgcgtgaaggtgctggctgggatagcgattttctagccagtattggtcagcagttaggaacggctgaatcccttgaactggggcggctggcgaatgtgaatccgcctgaattattgcgctacgatgcgcaaggacgccgtctggacgatgtgcgttttcaccccgcctggcacctgctgatgcaggcgctatgtaccaatcgggtgcacaatcttgcctgggaagaagacgctcgctccggcgcatttgtggcgcgcgcggcgcgttttatgttgcacgcacaggttgaggcagggtcgttatgtccgataaccatgacctttgccgccacgccattgctgttacagatgttacccgcgccgtttcaggactggaccacgccgctgctgagcgatcgctacgattctcacttattgccaggtgggcaaaaacgcggtttgttgattggcatgggaatgacggaaaagcagggcggttccgatgtcatgagcaacaccacccgcgcagagcgcctggaagatggctcttatcggctggtggggcataaatggtttttctcggtgccgcaaagcgatgcgcatctggtgctggcgcagactacgggcggtttgtcctgcttttttgtgccgcgctttttgcctgacgggcaacgcaacgcgattcgcctcgagcggctgaaagataagctgggtaatcgctctaacgccagctgcgaagtggagtttcaggatgccattggctggttgttggggcaggaaggggaaggaattcgtctgatcctgaaaatgggtgggatgacgcgttttgattgcgccctgggtagccatgccatgatgcgccgtgcattttcgctggcgatttatcatgcacatcaacgccatgtttttggtaatccattgatccaacagccccttatgcgtcatgtcttaagtcgcatggcacttcagcttgaagggcaaacggcgttgctgtttcgtcttgcgcgagcgtgggaccggcgtgccgatgccaaagaagccctgtgggcgcgtttatttacgcctgcggcaaaatttgtgatctgcaaaagaggtatgacgtttgtggccgaagcgatggaggtgctgggcggcattggttattgcgaggagagcgagctgccgcggctttaccgggagatgccggtaaacagtatttgggaaggttccggcaatattatgtgcctggatgtgctgcgcgttctcaataagcaagcgggcgtatacgacttattgtcggaagcgtttgtggaagtgaaagggcaggatcgctattttgatcgcgcggttcgtcgtttacagcagcagctgcgcaagccagctgaagaactggggcgagagattactcatcagctattcctgctgggctgcggtgcgcaaatgttgaaatatgcctctccgccaatggcgcaggcgtggtgtcaggtgatgttagatacgcgcggcggcgtacggttgtcagagcagatccagaatgatttattgctgcgggcgacggggggagtgtgtgtgtaagcgtatacgactgatgcgacgctggtttcgattaactcaatgaaatatgtgaaaattgtaggccggacaaggcgctcgcgccgcatccggcattgttcatttgctgtagatgacactcatgcatacagtatcgcctgtacgcgccagttatcaggctgctggtcttcgtacatggtaataatgcggtaccatgacgcaccttgttcatcggcctttaacgccacgatacgttccacgtcctgcggatcccctgaaatattgctaactgagatctgacctatttcattcaggcccgtcacgcagtcagcactggcgaattctgcagactgtgccgtggcgctcgcaggataagtcactaattgcagcgagggtgaggcaagtaattgtttcatcgtcagctccatttttcgtttccccacatgttgcagggcattccatcgcggtaataaacgcccaggcttccagccggtaatttattgtgcacaggtaaacgcatagggacgcaaagcaatgtaaagctgactatgtaagttgtctgatttatttacggtacaaaatggcttgtgaataccactgtcctgtcacgatggtttcgtccaccatgacgacaacgtaataatcagcttttgcagcgacagcttttgctctgatttctgctaatgcgtcatccggagaaccccgaaccatcgtgcttacgctacctattcgctgtaacccttgcgtctggtcgcggcgaatctcttgcggatggttcgttactggcggtgctggctgtggcgtaccttgcagtgcgctacaggcacttaacatcaacaccaataataaactggcaaaccggtaaataacgctattacgtttcctgctaaccatagtgtagtgccttattaatttaactttgggggaatgttcccgaattgttacctggtacgcgattttcgaatgaaaacgtgacgaaagcgtaacccacatctcaacattatgaactaataccgccagcagaaacttgtgctaaggatttcttcatgtcataccagacaaaaaggagagacagatgattgaaatagaatcacgcgagctggcagatattcccgttcttcatgcttatcctgtcgggcaaaaagataccccgttaccgtgcgtaattttttatcacggctttacttcatccagtctggtgtatagctattttgccgttgcgctggcgcaggctggtttgcgggtgatcatgccggatgcgcccgatcacggtagccgttttagtggtgacgcagcgcggcggttaaatcaattctggcaaatcttgctacaaagtatgcaggaattcactactttacgtgcggcaatagccgaagaaaactggctgcttgatgaccgtctggcagtcggtggcgcgtcgatgggcgcgatgacggcactgggaattaccgctcgccaccccacggtgaaatgtaccgccagcatgatgggatcgggctattttacatcgctcgcccgttcactgtttccaccgctgatacctgaaacggcagcacagcagaatgaattcaataacattatcgcgccgctggcagagtgggaagcgacaaaccacctggaacaatttggggacagacctctactgctgtggcatggcctcgacgatgacgttgtgcctgccgacgaatcactacgtttgcagcaggccttaagcgagacgggacgggataaactgctaacctgttcatggcagccaggcgtgcgtcaccgcattacgcctgaggcgttagatgctgccgtgacatttttccgccagcatctttaaacacgcagaatgctgaccccttgcgcttccagttgttgcaggatttccgggttagcatttttgccggtgataagcatatcgatttgatcggcacggctaaaaagcattcccgcgcgttcgccaatcttactgctatcaaccagtaccaccagtttccctaccacgctcagcatcttctgctctgccattgccgtcagcatatcggttttatacaacccttctgcggtcagtcctttgccgctggtaaacatccagtgcccggcatagagactgttttcgctgccctgcgggcttaaagtgatggactgacttttgttgtactgtccgcccataatgatcacgctgtcatgttcttgatcgatcaggtaatttgccagcggtagataattagtgatgatttgcactggcttgccacacatttcccgcccaagcagaaacgcggtggagccgcagttgatgactacgctttcgcccggattaaccagttgcgaggccgctttagcaatacgtactttttcatcgtgattctgcgcctgatgcagattcatcggcgtccagcgcgggcgctgttgggtaatagcttctgcgccattgcgcacctttttcagtttgccgctttcgtcaagtttattgatatcgcgtcgcgcagtggcaggcgaaattcccagacgctcaacgactttctcaacggtcacaaagcccaattgtgcgagcatttccaggaggatttgatgtctttgtgcttcagtcatgagctattccgataaaatttgatttttttagatgatatttgaaatagccaggaaatactacgccggatagcgcgaacttctccacgctatccggtataaacgacagattacaggaatgacttgaacggcagatccggttcaatagtgaagcaatcatcgaaaccgcgcggatagtggtactcgaagttgtctttatccagcggccaggtaaatttgccgccaacctgccagataaacggcttgaagccatacttcagacgatcttttttcatctcccacagcacgcggatctcttgcggatcggcctggaagtttgaccagatgtcgtggtggaacgggataaccactttcgcattcagggcttcacccatacgcagcatatcggcgctggtcattttgtcggtaataccgcgcgggttctcaccatacgatcctaacgccacatcgatctgatgttcgttaccgtgcttcgcataatagttagagtagtgggagtcgccgctgtgatacagggagccgccaggcgttttgaacagatagttcaccgcgcgatcgtccatgccgtccggcagtacgccagccgctttttgatcggcaggcagggtgatcagtgcagtacggtcgaaagcgtcaagcgcatgaatttcaatgtctttcacttttacaacatcgcccggtttgaccacgatgcaacgctctttcggtacgccccagccaatccacaaatcaacgcaggttttcggtccaatgaatggtacgtcatcagcacagttctgcatcacggcagcagcgacgttaacgtcgatatgatcgttgtgatcgtgagtcgccagtaccgcgtcgatctggcgaatcgcaaacggatcaagaacaaacggggtggtgcgtaggtttggctgcagttttttcacgccagccatgcgctgcatctggtgaccctgtttcattaacgggttaccgtgactttgtttgccagtgccgcaccagaaatcaacgcaaacgttggtgccaccttctgatttcaaccagatcccggtgcagcctagccaccacatcgcaaatgtgccaggggcgacctgctcttgttcaatttcttcattcagccagctaccccactccgggaaagtgctcaggatccaggattctcgggtgatacttttcactttactcatcgccatttaccttcatgatagttcaattcgaatcaatatgtgattggttttgattaatcctgacactattttttcaggaaggcaatgaccattttttgactttttgccagggaagtggttgttgattttgagtgtggaaagatttaatggaatgtgtaattcaattaactaaatgaatttaaatgaatagttgtttcgttgtgtgaatcccattctatccatgtggaattatttgcgggtcgcgtcacatttaatcataaataatcttgttgtgattacttttgaaaattagagtgagtgcacaacattccgggtgtgtggaatacccggttacctcttcttcaggagatcgttatggagatcctctacaacatctttaccgtgttttttaaccaggtcatgaccaatgccccgttgttgctgggtattgtgacctgtctgggctacatcctactgcgcaaaagtgtcagcgttattattaaaggcacgattaaaaccataattggtttcatgttgttgcaggcagggtccggcatcctcaccagcaccttcaaaccggtggtggcgaaaatgtccgaagtctacggcattaacggcgcaatttccgatacttacgcgtcgatgatggcaaccatcgaccgcatgggcgatgcctatagctgggtagggtacgcggtgctgctggcactggcgctgaacatttgttacgtgctgctgcgtcgtattaccggtattcgcaccatcatgctgaccggccacatcatgttccagcaggcggggctgattgccgttacgttgtttattttcggctattccatgtggacgaccattatctgtacggcgattctggtttcgctctactggggcattacctccaacatgatgtacaaaccgactcaggaagtcaccgacggctgcggtttctccattggtcaccagcagcagtttgcatcatgggttgcttataaagtcgcgccgttcctgggcaaaaaagaggagagcgttgaagatctcaaactgcctggctggctgaacattttccacgacaacatcgtctccacggcgattgtcatgaccatcttctttggtgccattctgctctccttcggtatcgacaccgtgcaggcgatggcaggcaaagtgaactggacggtctacatcctgcaaaccggtttctccttcgcggtggcgatcttcatcatcactcagggcgtgcgcatgtttgtggcggaactctctgaagcatttaacggcatttcccagcgcctgatcccaggtgcggttctggcgattgactgtgcggctatctatagcttcgcgccgaacgccgtggtctgggggtttatgtggggcaccatcggtcagctgattgcggttggcatcctggtcgcctgcggttcctcgatcctgattatcccaggctttatcccgatgttcttctccaacgccaccatcggcgtgttcgctaaccacttcggcggctggcgtgcggcgctgaagatttgtctggtgatggggatgatcgaaatctttggttgcgtctgggcggtgaaacttaccggtatgagtgcctggatgggtatggcggactggtcgattctggcaccgccgatgatgcagggcttcttctccatcggtatcgcctttatggccgtcatcattgtaattgcactggcttatatgttcttcgctggccgcgcactgcgcgcagaagaagatgcagaaaaacaactggcagaacagtctgcttaataaggagttttgattatgaccgtacgtattctggctgtgtgtggcaacggacaaggcagttccatgatcatgaagatgaaagtggaccagtttttaacccaatcaaacattgaccacacggtaaacagctgcgcggttggcgaatacaaaagcgagttgagcggcgcggatatcatcatcgcttctacgcacattgcgggcgaaatcaccgtgaccggcaacaaatacgtggttggcgtgcgcaacatgctctctcctgctgactttggcccgaaactgctggaagtgatcaaagcgcatttcccgcaggatgtgaagtaaggacgcgccatgaaattacgtgattcgctggcggagaataaatccatccgcctgcaggctgaagctgagacatggcaggacgcagtaaaaatcggcgttgacctgctggtggcggcggatgttgtcgagccgcgttactaccaggcgattctggatgcggttgaacagcacggtccgtactttgtgctcgcaccaggcctggcaatgccgcacggtcgcccggaagagggcgttaagaaaaccggttttgcgctggtgacgctgaaaaagccgctggagttcaaccacgaagataacgacccggtggatatcctcatcaccatggcggcggtcgatgccaacacgcaccaggaagtgggcatcatgcagatcgtcaacctgtttgaagatgaagaaaatttcgaccgtttacgtgcctgccgtaccgagcaggaagtactggatctcattgaccgcaccaacgcggcagcttaagaaggaattgaagatgtcattaccgatgttgcaagtcgcgctggacaaccagactatggatagcgcctacgaaaccactcgcctgattgccgaagaagtcgacattatcgaagtgggtaccattctgtgcgtgggcgaaggcgtgcgtgcggttcgtgacctgaaagcgctctacccgcacaaaatcgtactggcagacgctaaaattgctgatgcgggcaaaatcctttcgcgtatgtgcttcgaagccaacgctgactgggtgacggtaatttgctgtgcggatatcaacaccgccaaaggcgcgctggacgtagcaaaagagtttaacggcgacgtgcagatcgaattgaccggctactggacctgggaacaggcgcagcagtggcgtgacgcaggcattcagcaggtggtttatcaccgcagccgtgacgcgcaggccgcaggcgtagcgtggggcgaagcggacattaccgcgatcaaacgtctttccgatatgggcttcaaagtcaccgtcaccggtggcctggcgctggaagatctgccgctgttcaaaggtattccgattcatgtgtttatcgccggtcgcagcatccgtgatgccgcttctccggttgaagccgcgcgtcagttcaaacgttccatcgccgaactgtggggctaaggagcggatatgttgtccaaacaaatcccgcttggcatctatgaaaaagcgctccccgccggggagtgctggctggaacgcctgcgactggcaaaaacgttgggcttcgattttgtcgagatgtcggtagatgaaactgacgagcgcctgtcgcgcctcgactggagccgcgagcagcgtctggcgctggtgaatgcgattgttgaaaccggcgtgcgcgtgccgtccatgtgcctttctgctcatcgtcgtttcccgctgggcagtgaagatgacgcggtgcgggcgcaggggctggagattatgcgtaaagctatccagttcgcccaggacgtcggcattcgcgtgatccagctggcgggctatgacgtttactatcaggaagccaataacgaaacgcgtcgtcgtttccgtgacggcctgaaagagagcgttgagatggcgagccgcgcgcaggtgacgctggcgatggagatcatggattatccgttgatgaactccatcagcaaggcgctgggttacgcgcactatctcaacaacccgtggttccagctctacccggatatcggcaacctgtcggcgtgggacaacgatgtgcagatggagttgcaggccggaatcgggcatatcgtcgcggtacatgtgaaagacaccaaacctggcgtcttcaaaaacgtgccgtttggcgaaggtgtagtggatttcgaacgttgtttcgaaacgctcaaacagagtggctattgcgggccgtacctgattgagatgtggagcgaaacggcggaagacccggcggcagaagtggcgaaagcgcgtgattgggtgaaagcgcgcatggcgaaagcgggcatggtggaggcggcataatgcaaaagctaaaacagcaggtatttgaagccaacatggatctgccgcgctacgggctggtgacctttacctggggcaacgtcagcgctatcgaccgcgaacgcgggctggtggtgatcaagcccagcggcgtcgcctacgaaaccatgaaagcagacgatatggtggtggtcgatatgagcggtaaggtggtggaaggggaatatcgtccgtcttccgacaccgcgacgcatcttgaactctaccgtcgttatccgtcgcttggcggcattgtccatacccactccactcatgctaccgcatgggcgcaggcggggctggcgatcccggcgttaggcactacgcatgccgactacttctttggcgacatcccgtgtacgcgtggattaagcgaagaagaggtgcagggtgagtatgaactgaacactggcaaagtgattatcgaaacgctgggcaacgccgagccgctgcatacgccgggaattgtggtgtatcagcacggaccgttcgcctgggggaaagatgcccacgacgcggtgcataacgcggtagtgatggaagaagtggcgaaaatggcgtggattgcgcgcagtattaatccacaactcaatcacatcgacagcttcctgatgaataaacacttcatgcgtaagcatggtcctaacgcttattacgggcagaagtaaaacacgcgctgcggaaatttccttcttcgggagataactggtctaattccgcagccgtttttcaaaaaaagccccctgcgaagggggcaaagcaaactatggcaatgtttcgttggttatacctggtgctagcgataaatatccgcgctggcgtgcatattgccgttactccccggttcccgcatcagaattacgtggtagtacgttgcgccctgcgcatctgtttcttcatttaatgcctgacgtgcttcactttcagtggcgaagttatggttgatataaatcacgcctaagctctgtacgtcgtccatatttctggcctggtggttattaatttcaatggctgcccatgtatttgcacttagcaaaagcacagccagaagggctaaaacacgactgaacatagatacctcctcgacggctgactttgtgtgctctcctctgtgatgatcttctgatttaattttaatcaatgataaagaagttgatggtgaccatttctgatgcagttgttcaaaaaaacaccatgatgaagtgtgatgaacttcaaatcagcgtgttagtccactttggtgaaagatgagatttatttgtcggctggccttgagtttagcggggtatgtcagtactataacgcgtcatttttcagccgacctttaacacgttccttgcctccccgggattcggctgacccagacaggaggctgaataatccgtaaggagcaattcgatgcgtcattacgaaatcgtttttatggtccatcctgaccagagcgaacaggttccgggcatgatcgagcgctacactgctgccatcactggtgcagaaggcaagatccaccgtctggaagactggggccgccgtcagctggcttacccgatcaacaaactgcacaaagcacactacgttctgatgaacgttgaagctccgcaggaagtgatcgatgagctggaaactaccttccgcttcaacgatgccgttatccgcagcatggttatgcgtaccaagcacgctgttaccgaagcatctccgatggttaaagcgaaagacgagcgccgtgagcgtcgcgatgatttcgcaaacgaaaccgctgatgatgctgaagctggggattctgaagagtaatttctgatgaccaaccgtctggtgttgtccggcaccgtgtgcaggactccccttcgaaaggtcagtccatcaggaattcctcactgccagttcgtgcttgagcatcgttctgtgcaggaggaagccggctttcaccggcaggcatggtgtcaaatgcccgttattgttagcggacacgaaaaccaggccattactcacagtataacggtcggcagtcgcataaccgttcaggggttcatttcatgccacaaggcaaagaacggactgagcaaaatggttttgcatgccgagcagattgaattgatagattctggagactagccatatggcacgttatttccgtcgtcgcaagttctgccgtttcaccgcggaaggcgttcaagagatcgactataaagatatcgctacgctgaaaaactacatcaccgaaagcggtaagattgtcccaagccgtatcaccggtacccgtgcaaaataccagcgtcagctggctcgcgctatcaaacgcgctcgctacctgtccctgctgccgtacactgatcgccatcagtaatcggtcacggtccattaatacgactttgagaggataaggtaatgcaagttattctgcttgataaagtagcaaacctgggtagcctgggtgatcaggtaaacgttaaagcgggctatgctcgtaacttcctggtaccgcagggtaaagctgttccagctaccaagaaaaacattgaattcttcgaagcacgtcgcgctgaactggaagctaaactggctgaagttctggcagcagctaatgctcgcgctgagaaaatcaatgcactggaaactgttaccatcgcgtctaaagctggcgacgaaggtaaactgttcggttccatcggtactcgcgacatcgctgacgctgtaactgcagctggcgttgaagtggctaagagcgaagttcgtctgccgaacggcgttctgcgtaccactggcgaacacgaagtgagcttccaggttcacagcgaagtattcgcgaaagtgatcgtaaacgtagtagctgaataattcgttattcaacgagacgtaaaaacgccgaccattggtcggcgttttgcttttgtagcgagcacttgcagatatcgataagggccacaataagcagccctacgaagataattacttagctgcctgaatatcagccagcattggggcaagggctgggttgtccttagcgaagtttgcgtacattggctgtactttctcgataaacggagctttatctacctggtagactttcacgcccattttatccagttttgcaaattcttgtttctcttcctcgctccacaagtctttcatgtagctcattgattctttagctgcttttaatataactgcctgattttccgggctaagtttatcaaacgcagcattgctcatcagaaccacatcgggaaccatagtgtgttcgtcaaggctgaaggattttgccacttcaccgtgacgcatggtagtcagcgccatcacgctgttttctgccatatcgaccacaccctgctgtaaggctgtatacaactcgccgtaatccagtggcgtcgggttaccgcccatgactttgatcatttcaactgcgccagggcttggctggacacggactttcatgcctttcagatcgtctggtttcagtactggtttattgccatagaaactgcgggcgcctccatcataaaaagtcagcccgaaataacctttgcttttcgttgagtcgaggatttttctcccgatatcgccctgcatgacctgataataatgatcacgatcgcggaacaaataaggcaggctaaataatttataggaattttcaaatgcttccatttctgccgcattggtttttaccaggggaatagcgccagaacgaatcagctccattgtttctcgttgagtacccaatgttccatttggataaatacgaatagtaatatcaccgttagagtactctttgctctttttcgcaaagaactccatcgctttatgaacaggatgagacttatcctgattatgactcagttttaatgtcactgcccaggactggcttgcggataacataagaacagcaccgataatgccagcggatacttttattttcatagatgttccttttctaataaatatggcggcaggtgccgccagtgaatgcgcatcagtagcccagtgctcttggcaatgccatactgatttgcggaatataggtcaccattgccagcaccaataccatcacggcatagaatggcagcataggtttgataattttattaatcggtaatttagatacactacaaccgacaaataacacactgcctacaggcggagtacaaataccgatacacatgttcagtaccatgacaataccaaagtgaatcgggtccatgcccagttcggtgacaaccggtaaaaatatcggcgtaaaaatcagtaccgccggtgtcatatccataaaagtgccgataatcaacaggataatattgataataagcaggattattattgggttgtcagaaatagtgttaagcaaatcgagaatcaggaagggaacgtcagcgtttgacattgcccatgacatacccatcgaagaaccaattaataacaagacaattgcagtggtaataacggattccagaaatattttaggtaaatctttaactgagatttcacgataaagaaccagtgcaaggaaaagggtataaattactgcaattgcggaggcctctgtcggggtaaaaataccacttaatacaccccccataattaaaataatcaggaaaatactggggatagccatccatatcgcaacgccagcctggcgtaaagtcgggcgttctggctttggataaccgcgacgtaccgcgataataccggctattaccatcagtgccagacccagcaaaattcccggaacataacccgccaggaacagtgcggcaatagaagtaccaccactgaccagtgaatagacgattaacgtattacttggtggaataagcaaacccgtcggggcagaggcaacgttaaccgcagtactgaatgccgggtcgtaaccctctttaacctgttgcggatgcatgacgccgcccatcgcagccgccgaagccacggctgaaccagaaattgccccgaacagcatattggcgagaatattacagtgggcaagtgagcctggcagacgaccgccgagaatacgggcaaagttgattaatcgtcgcgctattcctccatggttcataatgttgccagacaagataaaaaatgggattgccaacaacgtaaaactatctaacccggaggctaacttttgggaaaccacactcaatgctgagttgaaatcgagttgtgtggaaattgatgccagtgtcgataaaccaatggcataaacaataggtacacctaatgccaacataaaaaagaaggcaccaaataacacaataatcggtaaccagtaatccataatttctccattcctactatggttggttgttgtttgttatctttagagtggttgtttaagttcggttaaaaccatatctatggtgtatataataataagtacaccactaatcgggatgctcatatagatatatcccatttgccagcctaaagcgggcgaggtctgacctgaatcgaatgtatccatcgttaatagcccaccaccatataccataatgatggttgcgaagataataacgataatctgaatacacaaaaataaatgacgtcgggcttttcctttcagcatcataggtagcaggtcaatcgccagatgccggttttgccctgcggtgtatgccccaccaaaaagtccaagacaaataaagagcaaacggctgagttcatctgtaaaaatactgggactagtaaatataaatcgtgcagccacctgccacgtcacacatgccacgatgatcgccaaaatggtaatgttcaatgctgcaagtagagcattaatagatctaattatatttcgcatagtgattaacctttgcaatatcattcatcctgtggctggtaaattgtcccattaagaaaaccaggccagtttttttcaaaccaaatacctcggataataggaaactcacgaacaggtgtttctctgacgtgaaagataccgttgcaataatgaataagtagtttatcttttttatcctcagtacgctctgaacgaaagcgccaggcatcacaaaaaccatttcgtgtttgcggaatagaatttccatccctgtcgagaataatacgtgctccccgactaccaccacctgcgtcaatataatgcgttaattgcgttaatacggcggcagaagtcagtgccatatgccgccacataaacagctcggcaacttcacccacatgtttgatagccaatccatgccgttggacaaattcgctcaatagcagggcatcgcgagtggcgcgtcggactttatcggcatggcaaataaatcccgcatggtcagacattcgtgcctgaattttttctctcacaaccgacaacggcatcccggtcccgttatcgtgcgcctgagtaatgatctctcttatagaagccagtgtaggagctaccagctgtgctatatctccattaatattccgcttttgcgtgcaaccaataaaacgtgccagacgaacagcaaaaacctgcccggcattcaatgctgcaccaccagggcgagtgacgccgtgtgtgccagcaacttcccccacggcgaaacagccgggcagggaggtttgtccccagatatccacttcaatgccgccattcatatgctgattattcatggcaaactgcaaaggctgtgtggtgagatcgtaaccgtgcatcttatacagcgagatagacagcggattcattcgttgcagccgttcgatgggcgatggtgccagagcgtcgttattttccagatacgcgcgaacgtcgtcgtccagtcgatctaatgagaacggcaggtcacccggcaccgcttcaggattgcgattgaaatccataaatacctgacgccctgattgctgctcttgcgctactgccatatctaacaagctggagccaaaatccatcacccgcgtggcgtggaacggccactgatagcctttacggaaaatgtttgaagccagctcctgggtggtgcgatagtaatccgcgaggaagttatactcgttaccctcagcatccacggaatagatatacgggatcacctgtacataggtgccggataaattccacggaaacgtgctacgcggcgtgcctataccaaactggctttcggtcagattggttagcgtcagaccttcctccagcgccagccccagcgagccgaagcatttatgtggataaacactgtcgcgataaagctcgccaggccctcctgttgccagtaccacattgggcgcagtcacaattgccagcccccatgggttatgggcgcgatgaccggtcgcgaggattgcccctgccacgcggtcttcgccgttttcgtcacgctgatgcagcagtttaatcactgttgcactggtcaacactggaatggcgaggcgctgtacttcttccaacagcactttcaccattaaccttgaggtacgcggcccacacgaggttgcacgcccggcttcgtcatggtcggtttgataacgaagaatcgcgccatagcgatcttccggtaattccagaccaagatattgcaacccgcctagagtgtgcagagaacctaccgcttcgacataagcggtgtcgtgatccatcgccccaccgctcgccagtgcctctgccagtttggtgaagttgtcgccgttgcccgcggtagcggcggtaaatagtgtctgtttatcggaaccagaacatgccgacgtccccatatataacccggcggtagcgatcagcacattttgctggcggcgtttaagttcaactgccgcacgtaatcctgctgcaccactgccgactaccagggcatctgtttgccagagtgggtaatcaacaccgtctaccgtgacaacccatgcgggctctgcctgtgcaaaaccctttgggaaagtaacgtgcgtcagcgcatcaaggatggtgtcatcaagctgactcatgcatcctccatcggcgtaaacaggctactttccatcaggcgtgggtgcttgataattggacggaaagccatatacggcagaatgtcgcgctcaatctccacacccggcgcgatttcaattaattcaacgccttctgccgttaactggaatactgcgcgttcagtgatatacaacacttcctgaccactttgctgtgcgtaggcggcgctaaaagtgattttttccacctgggtaaccagtttagggatttgacctgactgggtgatatgcaagccatctggcgttacatcaatcttgctacctttggcgtcgaacgtgccgcagaacaccactttacgggcgttttgcgcaatttcgagaaaaccgccgggaccaatgagattgccattgagatgggatacgttgacgttaccgtactgatccatctctcccatgccgaggaaggtgatatcgatccctccgccactgtagaactcaaattgatcgagtgatggaataatggcatcggcgttgcgggcgcagccgaaaaacgcatcatccagcatcataccgttatgcacgccttgctcgacgctcagccataaactttggtaaggcacgccttcgcgcagcgctacgcctggaatacccccaggaataccaaagccaaagttggttgaagcgccagctaccagttcgcgtgccgcccgacgggcaatcaggcgacgtaccggatgactaaccagttcaatggcgtcgttagaactcagacggcgatgttggccgctgatggtcaggtcgtaaccgccaagataggtttgtggttgttcgcggtgttcaacgatgccatcaaccagaatgcccggtaatttgacccggcgtggttcaatcgcgccagcttccagcacatcgcgtacctgtacgaacactttgccgccgctgttgtgtgctgccagcgccatggaatagctatccatatcaatcgcttcttcttcaaggctgacgttgcctcgaggatcggcataagtgccacgcaaaatcgcgtaatccactttgaaagggcgataacgaagtttggtttcaccgtcgatttcaatcagttctaccagctcgtcggtagtgcattcattcgacttaccgccgccattgcgtggatcaacaaacgatcccagcccaacgtgggtaaaaagccccggacgtccggcgccgatctcccgtagcagtgcctgaatcacgccaccaggaaagcagtaggcttcaatcgtgttattttttaccagcgcctgcattttgggcgaccaggtaaagtgcccggcaataatgcgtttgagcatctctgcgtgcgcaaaacggttagtgcctttgcagtcgcgatcgccaatacccagcgagtggattagcgtcaggtagcgagggtgtccggtttgcaggaaacgcgcttcaatagcagccagaatatggtcggcttccaccataccgccgccgttaccgctaatagcaatagtcgcaccgtcctgaatttgcgccgccagtgcctcggcggttgttatcttacgcatacaatttccttattgattatggaagctcacgctacttttttcggcaaaggcgcgcgtcgcctgctggcaatcctgagtggcagacattaatccggccagtagctggtgcgggtaatcggcatgtttattttccagtgccagaatcagttgcttaatatgcgccagtgccaccggaccgcatttttccagctgcgctaactggttcgccatccagctttccacctgttctttttctaccacttcatcaattaaattcgccgcctgggcttcctgcgccgtcaggcgtttacccagcatcagcatctggcgaccgaccaccggaccaacctgattaagcacacgttcaatgcccatccagccaggcaccatgccgagcatcacttccgggttagagaatttcgcgccggggcgggcaatacgaatatcgcagcacaaggccagttcaataccaccgccgatggtatgaccgttgagattcgcaacggttaattggggtatgtttcgcaggcgattaaaaacgtcattaccgcgtttaatccattttctgcccatatctaatggcgaataggccgaccacgatttaatatcgccgcccgcacaaaagaatttatcgccggttgccgttaattcgactaatcgtaatgtggtgtcgttttcaatttcatttaaataatggtcgagagattcgatcatctcttcgttaatagcatgacatttatcttcacggttcaatgtcaggcggcaggaagccgccactctgctgaacagaacgggttggtcactcatgatcattccttaacaataatgcgcgatgcgatcgacgctaatatccagcgtgctgttaatatctttctgccaccagtaaggcgagaatatttccagttcaatagcaccattaaatccggcgttttcaaccagccgacgaattgacggaatattgatgacgccatctcccggcataccacggtcattgaccagatcagtggtcggcactaaccagtcggaaacatgaaacgcgaggatgcgttttccggcacgcaggatctgactggcgagatccggatcccaccagacgtgataaacatccaccgccacgccgaggccaaactcaccatcgggatcgagttcatcacaccagtccagcgcctggcgtaacgtgcacaggcaagagcgatcggcagctgtcatcgggtgcagtggctccagcgcaattggcacgccgacatctttcgaatgtggcagcaactggcgaatcccttgttttacttgttcccgcgcttcgtacagatcttttgtgcccgttggcagaccgccaaccacctgcatataacaggcggcgttaagcaccgctgcgtcgtccagcgcccggcggttatcatcaatcgccagtttgcgttccgccagtgtcggcgcggtgtagtaagtgctacggcacaaaccggaaacgctcatgttactggcggcaagctggtgggcgatttgctggagatcttcaccttgcaactccctgcgccagggagcaatcgcgccaataccacgcgcggcgcaggcatcaataatggcgggtagcggcgttttatagcccagtgttgcggtattgatactgaataaatccgggcgttgtaacagatctctcatgattcagcctcagaagcgcggcatacttaagccgccgtcgatggcgaccgcctgaccacaggtgtaaatcagtttaccttccgccatcgcgcggacagtggaagcaatatcagccggataaccccaacgtccccacggcaccagacctttggcaatcagttcgtcgtaataagccgttgccggaatagtcatatcggttttgatgagaccagggcgcacttcataaacgccaatttgttcattacaaaggcgagcagcaaacagacgagcagcggcagaaacggcggttttggcaatggtgtattcgccgcgattcatcgccagcatgatggcgttgatggaactgacgaaaataatcgagcggtgcggcagctccgcttccggtttcggctgtgccagtaagcgcttactgaatgcctgagcaaggaagaacggcgcgcgggtgttaatggcaatgttttgatcgaagctgtctggttcgaggtcgaggaggtcaccgcgttttttcactgaaatccccgcgttattgagcagacagtccagccgcccccactggttttgcgccgcgtcgagcatctcttcatgcaaggagagatcgccgacatcggcagggaagcaaatgacttccacgccttctgccaaacattcttgttgtgtgatatgcagtttttctacgctgtcggcatcgggacgatcgttaatcagcaggttaaacccgccacgagcaagctccagcgcacagccctttccaataccacgagcggctccggtaatcacggcaacaggacgagtggatttcatacaatagctctctttttttgaatattgttttctaagtgacaattagcttgcgacgtgccgcaagaaagatcaaccatctggttggttgatatgcgatagtgatcacaggacatttgataacttgatgaaagtacaagtttttatcctttttactggagcttctaattaatcgggttaagatagttatcttgaagaggtcgtggggaagcgttatgtatcttgataccagcaacgtacagagcctgaaggaaaagctgctgttatgcgcggttaatgaatttgccgaatatggttatgaaggggccagggtcgataatattgttaaggctgcggggtgtagtaaacagacggtttatcatcactttggtaataaagaaaatttatttattgaagtactggaatatacctggaacgatattcgacaaaaagaaaaggcccttgatttctcagatcttccgccacaaaaagctattgagaaaattattgattttacatgggattattatattgctaacccctggtttttaaaaattgtgcatagtgaaaatcaaagtaaaggtgtgcattatgcaaaatcacagcgtctcttagaaattaaccatgcgcacttgcagttaatggaatccttattggatgaagggaagaaacacaatatttttaagccagatatcgacccattgcaggtgaatattaatattgctgcgcttgggggatattatttgatcaaccagcatacgcttggcctggtttatcatatcagtatggtttccccccaggcactggaagccagacgtaaggtcatcaaagagacaatccttagctggcttttggttgacccttcatctaccgcgcacgaataaaactgccatccggctggcgggtaaacaggacctgttgattattccccgtatcaatggttaagcccgtcaccacgccgctggcgttctggcggattttcaccatttgcccgttttgcaaattactcagcggcttacccgcgccttctacctgcgccattgcatagacatcggtagcgggcagtccgtggtcgcggaacagctgcgccatcgttttaccgggttcgacacggtaagagcgccattgattatcaattccgctatctggctggaatggttgcgtttgggtagtttgcggctgctcttctggctggccttcctgtataggttctggagcgaccggagccacctgatcaggatcattttgtggggtgactaattgcgcccgcagctgttcttctgtcggcggttgtgattgcgactgaatatctaactgcgcttcacgcgtcaccaccggcgcgttgggcgtatcatcagatggaagcagaaatccgaccaccaatacaatggcggcaataatgatcccccgacgatgcatcggcggcagcgggtccatgaagcgaaaattgtccggcgcgtgccagactttctccagggttggttttagttcaaagcgcccgggcatggtttcctcctgctccgcgtcttgttcctcaatcatagcctatgaataagctaacgctatgatgtccgtggtaaacccgcctttattatattcatacgggatattgctattgtttctttttccccgggatttgtcatcattcctgcgacaaagttttacccaaagaagtgtggctgatatgctgcccgctacttttataccctaagaaaggaaatacgatgaccaccccaacttttgacaccatcgaagcgcaagcaagctacggcattggtttgcaggtagggcaacaactgagtgaatctggcctggaagggctgctgccagaagcactggttgcaggtattgccgatgcgctggaaggcaaacatccggctgttccggttgatgtggtgcatcgcgcgctgcgtgaaatccacgagcgcgccgatgccgttcgtcgtcagcgtttccaggcgatggctgctgaaggtgtgaaatacctggaagaaaacgccaaaaaagaaggtgtgaatagcaccgaatctggcctgcaattccgcgtgatcaaccagggtgaaggcgcaattccggcacgtaccgaccgcgttcgtgttcattacaccggtaaactgatcgacggcaccgtgtttgacagctccgttgctcgtggtgaacccgctgaatttccggttaatggcgtgatccctggctggattgaagcactgactctgatgccggtaggttctaaatgggaactgactatcccgcaggaactggcatatggcgagcgcggcgcaggcgcatccatccctccgttcagtaccctggtgtttgaagtcgaactgctggaaattctctaagcagcgcattctgttcccctcgaaccagaggggagcaggcattcagcaataaacccttcagtttgccaaacggcgctattttgtgttgcaaagaccccgtaagcgtgtatttttgtgagctgtttcgcgttatcaccgtgatatgacactcactttaaacataaaattaacattagatctaaatcttagtattcatcccgcgtattgttacctaatatcgatgagtcccgatacagattcgtcgtatcatagactgactaaaggccgtagagcctgaacaacacagacaggtacaggaagaaaaaaacatggtagatcaggtaaaagtcgttgccgatgatcaggctccggctgaacagtcgctacggcgcaatctcacaaaccgacatattcagcttattgccattggcggtgccattggtacggggttgtttatggggtccggcaaaacgattagccttgccgggccgtcgatcattttcgtttatatgatcattggttttatgctctttttcgtgatgcgggcaatgggggaattgctgctttcgaatctggaatacaaatcttttagtgacttcgcttccgatttactcgggccgtgggcaggatatttcaccggctggacctactggttctgctgggttgtaaccggtatggcagacgtggtggcgatcacggcttatgctcagttctggttccccgatctctccgactgggtcgcctcgctggcggtgatagtgctgctgctgacgctcaaccttgccaccgtgaaaatgttcggtgagatggagttctggtttgcgatgatcaaaatcgtcgccatcgtgtcgctgattgtcgtcggcctggtcatggtggcgatgcactttcagtcaccgaccggtgtggaagcgtcattcgcgcatttgtggaatgacggcggctggttcccgaaaggtttaagtggcttctttgccggattccagatagcggttttcgctttcgtggggattgagctggtaggtactacagctgcggaaaccaaagatccggagaaatcactgccacgcgcgattaactccattccgatccgtatcattatgttctacgtcttcgcgctgattgtgattatgtccgtgacgccgtggagttcggtagtcccggagaaaagcccgttcgttgagctgtttgtgttggtaggtttgcctgcggctgccagcgtgatcaactttgtggtgctgacctctgcggcgtcttccgctaacagcggtgtcttctctaccagccgtatgctgtttggtctggcgcaggaaggtgttgcgccgaaagcgttcgctaaactctctaagcgcgcagtacccgcgaaagggctgaccttctcctgcatctgtctgctcggcggcgtggtgatgctgtatgtgaatcccagcgtgattggcgcgttcacgatgatcacgacggtttccgcgattctgtttatgttcgtctggacgattatcctttgctcgtacctggtgtatcgcaaacagcgtcctcatctgcatgagaagtcgatctacaagatgccgctcggcaagctgatgtgctgggtatgtatggcgttctttgtgttcgtgatcgtgctgctgacactggaagatgacactcgccaggcgctgctggttaccccgctgtggtttatcgcgctggggttgggctggctgtttattggtaaaaaacgcatggcgaagtaatgccgctaaggcacctgcgggtgtctttcaggctgcaaaattgcctgatgcgctacgcttatcaggcctacagaacctctgcaatatattgagtttgcgtgcttttgtaggccgggtaaggcgtttacgccgcatccggcatgaacaaagcacactttgtcagcaatctcctttgtctttatacattcctaaaaatacttcccgtcatcgacagctctcaggcgcgggcttaccgtggatctttgccactcattgcagagttcactatggctaagcacagttggttattaatcgccgcattacctctctccatttcaccttcctggggcgcagatttttattaccgccagcaggagaaaggcacggtttatgttgccgaacagaagggagaaaaggatgagatcctctccgaactgccgggcgttaatttttcccgcctctggcgtattgccaatttagccaataaccaagaaacccgcttactgtccgattttaatcccgataagttcgattgcgatgatcggaataattgccagcatacctggctcaccgatggacgctctgttctttggtctggcaaagtcctgaaaaatccgcccggtgaacctaatgtcgatgccgccagttttcaggcattcggtgctttcgctgccgataaacgcagcgtctattttgacggtcagcgtaccgatgatagatgaagtggatatgtatatagctgtgtctcagttgcaaacaaatatttatgtaccgaaataaaagtatcaatagacaattaattaataaatcaggagataaagtggctatattacatccacaggagtgctggttgctggaaagaataatgtcgccggaatattatcggcgtcgttttgagggctggcaggagtttgtcgagctgtgcgagcgacaggtggcagagtggagcaagaccatgccgctggatgtgcgccgtcgtccgctgtgcgagcagattgacgtcgtctggggcgggcgagtgttgcccaatatccgcagtactttaaagtcggtacagtatgactttattcagctacagcagggggacctgcgggtactgcaatccgggggcaatattagcagtgatatgaaaggactaattgattatccgtcggactggatgtcactcgccgcgcaaaaacagtatgacagactgaaatggcgaggtgcacattataataatttaatcagacgtacctcgggcggatactggtatgacggcgaactgacttattattatgaggaaagtctgcacggcccgctggccctgccgatgcaattaccgttgtatgagctggatagtagcgtatacctgcgtgaggatgactcggtaacggtggctggcctgtatctgccggatatcccagatgccagcgcccaactgttgtaccggagtgaacatattcccgaggcttggcaggggcgggtacgaacgaagtatgtcaacgaggctgggatacaagaatattactgggaaagcggggcgtgggcaaaatgcaattggaaacgtatacggcgggtggcaaaccgatttatcaatgtgccgccggagggatttttcccacagggcatgccggaggagttgtacaactggccacagcgcgaagcgcagtatgttacagaccggcagcggatagcggcctttagcggtgaagcttgtcctcatagcggggagtggtcgatttttgtagaaggtagacaagcgacggtgacactggagcagggagagcagatgccagaatggacggacaggaaaatggagggggagtataaaagaggcgagaaattccatgtgctgtggtcgctgatgaaccgccatgatggcgggtcggtgtgggtggaagcgtagcggtagctggatgtacacgtaaaaaccagggaatgggtgattttattctggcttatacaggagcgatgaataagtaattatattaatgaaaaaaataagttagtaaccgttgaaggaacttattattggctgaataatgaattttcccagttcagtagatacaaaagattgtcccggagtggtgaataactcaaagcatttgaaaacgcacctgattgtgtaaaccaggtgcgttgatcgaacaaattactcacccgccagcgcgcgtgggaacagtacattgttttccaggctgatgtgatccatcaggtcatcaatcagttcattaataccgttatacatcgctttccaggtggtgcaggcttccggcggcggtgtgacgttattggtggtgtgtttaatcacttccagcagttcgcccgcttcatcgtgctcgctttccatcacgctgattggtcccattgcctggctgcccatgccttgtttgatcatcgggaagaggatctgctcttctttcatcatgtggctggaaagctcttcatgcagcatagtcaggtattttgtcagcccttttggcacgctcggtttgtcggcgtgaacgcgctcgactttagtcgcttgcaggatcagctccggcagctgctcgcggtgacgatcgtggtagcgcacgatgatatggtcaatgatttctgccagcggggcgctacgccagtctttctcaatcggttgttcagcaagctttgccagttcagcttcaatgacctcaacatccagttctttacgtgccgccgcgcgcgccagcgtctgcttaccgccacagcagtaatccatatcatatttacgaaacagagccgaagcgcgagggatagagagcgccagttcacctaaaggttggtcgcgataagccatagctgatacctcattcttaataagataagatgtattttaaatgcatctttaaggcaaaagctataacccttacgtagcagaggcttatttaactcactgccagcgtgtcaactttctgagacagattcagttaaaggtttttctggttttgctctgaccgcaatgaccacgccaatcactaacagcgcgataccgctcagcgtcattagcggcggcatttgctggcggagtaaaaaggtgtacagcaaacctgccagcgtttcgaaaacaatcagcggcccgagaatcactgtcggtaatcgctggctggcgacgttccagcagagtgcgccaacccatgagcaaagcacggctatcgcaaccatcagactaataaacaccagcggacgggggccaaaaggtaaggagaagtccggcgtttgtatattcagccagtaacaggcgacgagatagccgatgagagaaaccggcagcgtgaccagcgcctgcgccgtcgcccacatcatcggatgtttgtcgggattttcccgcagccagcgggcgttgcgcagggcataccatgcccagcagaccacggaaactaacgctagcacgatgccagaggtataacgtgcccagtcaaaatcggggagtccgtggtttaactcagcaatattcacactcgccaggccgatgccaatacaaatcagtgccggggcgagttttccccacgcgagtttgccgtcgcgctggctataaagcagattggcaaagacaggaatgaccaccggcagggtgccgataatcatcgtggaaacaggcgcgccagtacgttgaatggcactggcaaggcagaagtaataaatgaggttgcccatcatagtgagcatcaaggcggtaagccagtcccgacgcgccaactgacgcagacgcacgcgtcccagccaggcaatgggcagcgcaattaaccctaacgccagataacgccccatcgactgcaacatcgccgggtattccggtacgatcaacggcccgacaaaaataagcccccacatcaaccctgctaacagggcgtacagcacgccgctaatcattactggcatccattggtctgtcagaagaaagttcaggaagcagacatgattgctcccggcatcccgtcattattagagaggatgcgggaggatgccactttaattaactagttattaacattaaaaagatggcttacgctttcggctaacgttgtcgttgggcggccaatcaatttgctaagcgttttgctgttatcaaacagaccacctttcgatgcgccaacgtcagaatccgccagcatatccgccagtccgtcgggcagtccgacgcttttcagtgccgcggcgaaatcggcttcgctcagattttgataggtaacggattttccgctctgtttggtcagctctgccgctaactgtgtcaacgtccaggcactatcgcccgccagttcgtaaaccttgccttcgtgaccggcttcgctaatcacgcgtgccgcagctgccgcataatctgcccgcgttgctgaggcgattttgccatcgcccgccgcaccgataaatacgccgtgttccagtgctgccggggcgctggcgaggtagttttcggtgtaccagccgttgcgcagcagggtgtaaacgatgccagaatcagccagcattttctccgtctcgatgtgctcatcggcgaggccgagcggggaggtatctgcatgtagcaggctggtataagcgataaatttcacgccagccgcctttgcggcattaataacattacgatgctgcggggcacgttgacccacttcgctggaagagatcagcagtagtttttccactccctgaagtgcagatgtcagtgcggcttcatcgccgtagtcagcctgacgcacggtaatgccttgtgctgccagggcctgggcttttgccggattacgaacgatagccactatttggctggcaggaaccgttttcatcaaggattcaataacatagtgaccaagttggccagtggcaccagtaatagcgatcatgggaagtctccatcgttttgtcttgtgtttaaatacgctaacacctaaacttacttttagtaagtacgtacaaaaaggtaagtatgaaatgagtcaggttagcctgtcgcaacaactgaaagagggtaatctctttgcggaacagtgcccgtcgcgcgaggtgttgaaacacgtcaccagccgttggggggtattgattctggtggcgctacgcgaaggtactcatcgctttagcgacctgcggcgcaaaatcggtggggtgagtgaaaagatgcttgcgcagtcgttacaggcgttagaacaggatggttttcttaaccgtatcgcgtatccggtggtgccgccgcatgtggaatacagcctcacgccgctgggcgagcaggtgagcgaaaaggttgctgcactggcggactggattgagttgaatttgcccgaggtgttggcggtgcgggatgaacgtgcggcataactgccggatgcgctgagcttatctggtctacggtgcatggcttgtagggcggataagatgcgccagcatcgcatccgccaataaatgccggatgcggttgatgatttataggccgaaaaagaagtgttttacttactcaaatccacctgataaatcgcaaacccgatatcatcggtcgcgactttattcatcggatattgccctttctctttaataaacgctgcggctttatctgacggggaagtttcgaaacggatatccagtttcttatcgccggctatcggtgctaaacgccagttgttatctgccgccgggtgaatttcccccgcacgtttcgactcatcagcaatccacgctgccagcaccgagcggttctcatccggtgaagcaaaagcgatatggctgtcgcccgtaccggcaaatttgccgccgtaagcgcgatagttattggtggcaacgaggaacatggcgttcggatcaatcggcttgccgttaaaggtcaggttcttaatcctttccgcattggcattaatcatctggcactcgccgtcataacgggcgggttgggtaacatcaatctgataattcacaccatcaatcacatcaaagttataagtgcggaaaccatcccagttaatgagtgactgtggtttcgtgctgttaggatcaatctggttaaactgtccggcagagcattccagccactctttcacctctttaccgctggctttcaccacaatcagcgtattggggtagagataaagatcggcggcattacggaaggtcaactggcctttttccacctccacatagcttgccgggtcatttttgcgaccaccaactttaaacggtgcggcagctgaaagcactggcagttttgccagatccggatcgctctgaatgtaatgctcgacatacgctttttgcgcgttgttcaccacctgcacggtcggatcgtcctgcaccagtgccagatagctatacatattgtcggcagatttaccgattggcttgctgacgaactggcgtgtggcatcgtgatcggctttgagtgtttctaccagcttgctgtcttccgccgcgagggattttttattagcgatgtcgtaaatcggtcgtgcttccgctttcgcctgcgtcacctgccatttaccgctgtcattactgagttgtaagtcgaccacaccaagatgatcgccccacatgcctggcattaccgccggaacaccattcagcgtgcctttcgcgatatcagctccttcgatatcagcaaaatctttacttgggaaaacggcgtgagcatggccaaacataatggcgtcaacacccggaatttcactgagataataaactgagttttccgccatcactttatacggatcggcagacagcccggaatgcgccagaacgacaacgagatcggcacctttctcacgcatttcaggcacgtatttgcgcacagtttctgttatatcgttaacggtgactttgccggacaaattggctttatcccaccccataatctgcggcggcacgacgccaatatagccaatctttaacgtctgtttttttccgtctttatcgaccacttcggtgtctttaattaaatacggtgtaaacatgggctgtttggtttttgcgtcaatgacgttggcatttacataagggaatttcgctcctgccaacgcatttttcaggtaatccagaccgtagttaaactcgtggttgccaagcgtgccgacggtatagtccagcgtatttaatgccttatagaccgggtgaatatctccggcttttaatcctttcgccgacatgtaatcggccagcggacttccctggatcaagtcgccgttatccaccagcacgctatttttgacttcattgcgggcatcgttaatcaggcttgcggtgcgtaccagtccgaacttttccgtggcggtgtctttgtaataatcgaaatccatcatgttgctatgcagatcagtggtttccatgatacgcagatcgaccgtcgctgcattcacactggcggcaatcagcgtggccaggagcgttgcgctaaacttaatcatcagggacatccttttattatcgggaatacgaaagaaaagggagaataaacgtcttacttatagaacagtgaagaatgccacaattttacgctttgaaaatgatgacactatcacagttggcgcattcattaacgatagggtataagtaaaacaataagttaacaccgctcacagagacgaggtggagaaatgttagatcaagtatgccagcttgcacggaatgcaggcgatgccattatgcaggtctacgacgggacgaaaccgatggacgtcgtcagcaaagcggacaattctccggtaacggcagcggatattgccgcacacaccgttatcatggacggtttacgtacgctgacaccggatattccggtcctttctgaagaagatcctcccggttgggaagtccgtcagcactggcagcgttactggctggtagacccgctggatggtactaaagagtttattaaacgcaatggcgaattcaccgttaacattgcgctcattgaccatggcaaaccgattttaggtgtggtgtatgcgccggtaatgaacgtaatgtacagcgcggcagaaggcaaggcctggaaagaagagtgcggtgtgcgcaagcagattcaggtccgcgatgcgcgcccgccgctggtggttatcagccgttcccatgcagatgcggagctgaaagagtatctgcaacagcttggcgaacatcagaccacgtccatcggctcttcgctgaaattctgcctggtggcggaaggacaggcgcagctgtacccgcgcttcggaccaacgaatatttgggacaccgccgctggacatgctgtggccgcagctgccggagcgcacgttcacgactggcagggtaaaccgctggattacactccgcgcgagtcgttcctgaatccggggttcagagtgtctatttattaattaatttatgcagcaggtccatcacttgctgcacctcttcctgagtaagcgccccgtctttggcccattgcacgcgaccgtctttatccagcaccactacagcggaacttttttcatccagctgccaggcaccgcgtgcgacgccattgctatcaacaataaactgcgaccagggataaagctttttattactctccagactgctgcgcacaaacatgccggaacccggaattgcgtcgtcggtgttaacaatggtggtggtctggtaacgatcgtgcggtaacttcgctgatttaatcgcttcaatcagcgtcgcgtttttctcttttgcagaggtgcgaccagcaatatgttgcagtactcgcacttttcccactaactgcgcgctgttccaggttttgtagctaaactgatctttatcaagcaccaactcgccacgatcggtgatgccaatcggcggcactcgctgaccggtttcgaactgatgtgcggaagccatcatcggcaacagcaggcaggtgagtgccagaatcttgcgtagggtcatggtgtttccttcttatgatatgcaggtgatccgaccacttgggtctgagttttaatcatatgtgctatttatcgaatttcccgcaagtgtgatgccagtttgcggtcaagcgcacaaatcatatgaaaaatgaatgcttatactgaagaccgcgcttcggtaaaaagataattctgaataattgtaacctttaggtaaaaaaagttatacgcggtggaaacattgcccggatagtctatagtcactaagcattaaaatttgcgcctcataatagttgggccgattgtggcaccgcacaggcgtaatactcagcaggagataacaatgaaaattttccaacggtacaacccacttcaggtggcgaagtacgtaaagatcctgttccgtggacggttatacatcaaggacgttggcgcttttgaatttgataagggtaagattcttatcccaaaagtgaaggataagctgcatttgtcagtgatgtccgaagttaaccgtcaggttatgcgtctgcaaacagagatggcttaaccaaagtgctatgcagtaataagacggctcctgattcaggagccgttgatgtttctgggggttacgcgacgctttcttctttatctttagcgtcaggcagttttggcgaaagggcggtggccttgctgtcgatccgggtcaccagcagctggtcgatgcggtagttatcgatatccaccacttcaaatttgtagccggcgaatttcaccgaatcggtgcgtttcgggatcttacgcagcataaacatcataaagcctccgatggtttcgtagttgcccgactgcgggaactcgtcaatatccagcacgcgcatgacgtcgtcaattggggtgccgccgtcaatcagccatgagttctcatcacgggcgacaatctgctcttccagcccctgaccgaccagatcgcccatcagcgtggtcatcacgtcgttgagggtgatgatccccaccaccagcgcgtactcgttcatgatcaccgcgaagtcttcacctgcggttttaaaactttccaacgcctctgaaagggttaacgtatccggcacaatcagcgtgttgcgaatttgtacgccgctgttcagtgccaggctttggttagccagcacgcggttcagcaggtctttagaatcgacataaccgatgatgtggtcaatatcttcattacagacgaggaacttagagtgcggatgttccgccaccttattcttcaggctttgctcatcttcgtggagatcaaaccaaatcacgttttcacgcggtgtcattgaagacggaacggtacgggattccagctcaaagacgttttcaatcagctcgtgttcctgtttacgtaacacgcccgccagcgcaccggcttccactaccgcgtagatgtcatcagaagtgatgtcatctttacgtaccattggcagtttgaaaatacggaagatcatgttcgccaggccgttgaagaaccacaccagcggggtgcaaacgtacaggcagaagcgcatcgggttgatgatacgcaaagccaccgcttctggcgcaatcataccgatgcgtttcggggttaaatccgcaaacaggataaacatgccagtcactaacgagaaagagagaataaagctcagttgctcagagagttctgccgacatatagcgggagaacaggctgtgaaaagctggagaaaatgccgcatcaccgacgataccgccgagaatcgcaactgcgttcagaccgatttggaccaccgtaaagaacatgccgggattttcctgcatattcagaacgcgttgggcatttatattgccttcatcagccagcagtttaagtttgattttgcgtgaggcggcaagtgagatctcagacatcgagaagaacgcacttacagcgatcaagcagagtatgactaaaatactgtttaacatatcttatccgacctttcaggccagatcctcggaaggggaagttgattaatttgtgtgaaatacacattgaaagccgattcgaagaaagtgaaccggcattttcagtggctagtatagcgtaaggtactgtaaagtcgccagagggttaaaattcagactgctgataaatgcaatactgcctgatgcgctatgccaatcaggccttgtattatccctccagtgcagagaaaatcggccagttttctctgcctgcagtccgcatgccgtatcgggccttgggttctaacctgttgcgtagatttatgcagcggactgcctttctcccaaagtgataaaccggacagtatcatggaccggttttcccggtaatccgtatttgcaaggttggtttcactatggaacatgaacttcattatatcggtatcgacaccgctaaagagaaactggatgtcgatgtgttgcgtcctgatggtcgtcatcgcaccaaaaaattcgctaacaccactaaagggcacgatgagctggtgagctggctgaaaggtcacaagattgaccatgcgcatatctgcatcgaagcgaccggcacctatatggaacctgtcgctgagtgcctttacgatgctggctacatagtgtcagtcattaatcctgcgctgggtaaagctttcgctcagagtgaaggactgcgtaacaagactgataccgtggatgcgcgcatgctggcagagttctgtcgtcagaagcgccctgcagcctgggaagcgcctcacccgcttgaacgcgcgttgcgtgccctggtagtccgccaccaggcgctgacagatatgcacacgcaggaactgaatcgcactgaaacggcgcgggaagtccagagaccgagcattgatgctcaccttctgtggcttgaagcagagctgaagcgtcttgagaagcagataaaagacctgacagacgatgatccggatatgaaacaccgcaggaaactgctggaaagcatcccgggtatcggagagaaaacatctgcggtattgctggcttatatcggtctgaaggaccgcttcgcccatgccagacagttcgccgcttttgcgggtctgacaccacggcgttatgaatcaggtagcagtgtgagaggggcgagccggatgagtaaggccggacatgtgtcgcttcgcagggcgttgtatatgcccgcaatggtagccaccagtaagactgagtggggacgggcgttccgcgaccgtctggcggctaatggcaagaaaggaaaggtgattctcggcgcgatgatgcgcaagctggcacaggtggcgtatggagtgctgaagtcaggcgtgccgttcgatgcgtcacggcataatccggtagcggcgtaaaaatcgcggaagggatgaaaaaaacagcgcctgacggcgctgtgtctggcatgcctgcaatccgggaaaccggaccaggaaaaaacttgcaggccataacagtatctacgcagtccttgcaatatattgaatttggacgattttgtaggcctggtaaggcgtttacgccgcatctggcataaataaagcgcactttatcaacaatctacatttgtacccgtaacgctatgcttccggtggcagacagacgccaattccgccaattccacagtaaccatacgggtttttatgcagatattgctggtggtcatcttcggcataataaaacggtgtggcgttagcgatttccgtggtgatgtgacgatcatcatcggcggcaagcatcgccgcctgaaaacgttccagactggcgcgagctgcggcatcctgttctggggtcagcggataaatcgctgaacgatactgcgtgccgtggtcattgccctgacgcattccctgggcgggatcgtgattctcccaaaatacctgtagcaactgctcatagctgatgacggaaggatcgtaaacaatgcgtaccgcttcggcatgacccgtatcaccggagcacacttcccgataagtcggatttggcgtatagcctccggtatagcctgcggcggtgctgtaaacgccgggtaactgccagaacagacgctccactccccagaaacaacccatcgcaaaaatggcaatctccattccgtcaggtacattggtcattgagtgaccgttgaccgcatgcagcgtggctacgggcatcggggtgttacgtccaggcagggcatcggcgggggaaaccagatgctttttatcaaataaactcatggtgtcgctctcccgaaaatcggtcattggggttaaggttgtaacaagaggcgtatttgcacacaataaccaccgtgaataggtctaaagtaaaacataagaaatatttggggtttagtctgctttttaatccatattactggatttttgttaagccgtttaacggcgttccaggggcaggaaaaaaggatattcaggagaaaatgtgcgctatatccgacagttatgctgtgtaagcttactctgcttaagcggatctgccgtcgccgcgaacgtccgtctacaggtcgaggggttatcgggacagctggaaaagaacgttcgtgcgcagctttctacgattgaaagtgatgaagtgacgccagaccgtcgctttcgcgcacgcgtcgatgatgccatccgtgaaggtctgaaagcgctgggttattaccagccgaccattgaatttgatctccgtccaccgccaaagaaagggcggcaggtattgatcgccaaagtcacgccaggtgtgccggtgttaattggcggcaccgatgtggtattgcgcggcggcgcgcggaccgataaagactatttgaaattgctcgatactcgcccggctattggcacggtgctgaaccagggcgattatgaaaatttcaaaaagtccttaaccagcattgcgttgcgtaaaggttatttcgatagcgaatttaccaaagcgcagctgggcattgcgctcggcctgcataaagccttctgggatattgattataacagtggcgaacgttaccgctttgggcatgtgacctttgaaggatcacaaatccgcgatgaatacctgcaaaatctggtgccgtttaaagagggcgatgagtacgaatcgaaagatctggcggaactgaaccgccgactttctgctaccggctggtttaactcggtggtggtggctccacaatttgataaagcgcgcgaaacgaaagtattacccttgacgggcgtggtttcgccgcgaactgaaaacaccatcgaaaccggggtcggttactctacggacgtgggaccgcgcgtgaaagcgacgtggaaaaagccgtggatgaactcttatggtcacagtctgaccaccagtaccagtatttccgcgccggaacagaccctcgacttcagctataaaatgccgctgctgaagaatccactggaacaatattatttggtgcagggcggttttaagcgcactgacctgaacgataccgaatctgactccactacgctggtggcttctcgctactgggatctctccagcggctggcagcgtgccattaacctgcgctggagcctcgaccactttacccagggtgaaattaccaacaccacgatgctgttttatcctggggtgatgattagccgcacgcgttctcgtggtggcctgatgccaacctggggcgactcgcaacgctactctatcgactactccaacacggcctggggctcagatgtcgatttctccgttttccaggcgcagaacgtctggatccgcacactgtacgatcgccatcgttttgtgacacgcggcacgctgggctggattgaaacgggtgatttcgacaaagtaccgccggatctgcgtttcttcgccgggggcgatcgcagtattcgcggctacaaatacaaatctatcgccccgaaatacgccaacggtgacctgaaaggggcctcgaagctgataaccggatcgctggaataccagtacaacgtgaccggaaaatggtggggcgcggtgtttgtcgatagtggcgaagcggtaagcgatattcgccgcagcgactttaaaaccggtaccggggtcggcgtacgctgggaatcgccggtcgggccaatcaaactcgattttgccgtaccggtcgcggataaagacgagcacgggttacagttttacatcggtctggggccagaattatgagtttatggaaaaaaatcagcctcggcgtggttatcgttatcttactgttgctgggatcggtggcgtttctggtgggcaccaccagcggcctgcatctggtatttaaagcggcggatcgctgggtgccaggactggatattggcaaggtctccggcggctggcgcgatctcaccttgtctgacgttcgttatgagcagccaggcgtggcggtaaaagcgggtaatctgcatctggcggtcggtcttgagtgcctgtggaacagtagcgtttgtattaatgacctggcgctgaaagacattcaggtcaacatcgacagtaaaaaaatgcctccttctgaacaggttgaagaagaggaagatagcggtccgctggatctctccacgccgtatcccatcaccctgacacgggtggcgctggacaacgtcaacatcaagattgatgacaccacggtgtcggtgatggacttcacctccggcctgaactggcaggagaaaaccctgaccctgaaaccgacgtcgctgaaaggcctgctgattgctctgccgaaagtggcggaagtggcgcaggaagaagtggtcgaaccgaaaattgaaaatccgcagccggaggaaaagccgctcggcgaaacgctgaaagatctcttttctcgcccggtattgccggaaatgaccgacgtgcatttgccgcttaacctgaacattgaagagtttaaaggcgagcagttacgcgtgacgggcgacacggacatcaccgtgcgcaccatgctgctgaaagtgagcagcattgacggcaatactaaactggacgccctggatatcgattccagtcaagggatcgtcaacgccagcggcacggcgcagctgtcagacaactggccggtggatatcaccctcaacagcacactaaacgtggagccgttgaaaggagaaaaactgaagctgaaagtgggcggtgcgctgcgcgaacagctggagattggcgttaacctttccggtccggtggatatggatttacgcgcccagacgcgactggcggaagccggattgccactcaacgtggaagtgaacagcaaacagctttactggccgttcaccggtgagaagcagtatcaggcggatgatctgaaactgaaacttaccggcaaaatgaccgattacacgctctctatgcgtacggcagtgaagggactggagatcccgccagccaccattacccttgatgccaaaggtaatgaacagcaggtcaatctcgacaaactcaccgtcgcggcgctggaagggaaaactgaactcaaggcgttgctcgactggcagcaggccattagttggcgcggtgagctaacgcttaacggcattaacaccgccaaagagatcccagagtggccgtcgaaactcaatggcttgattaaaacccgcggtagcctgtacggcggcacctggcagatggaggtgccagaactgaagctgaccggtaacgtcaaacagaacaaagtgaacgttgacggcacgctgaaaggcaacagttatatgcagtggatgatcccagggcttcatctggaactggggccaaacagtgccgaagtgaaaggcgagctgggggtaaaagatctcaatcttgatgccaccatcaacgcgccggggctggataacgcgctgccggggcttggcggtacagcgaaagggctggtgaaagtacgcggcacggtggaagcgccacaactactggcagatatcaccgcgcgcggcctgcgctggcaggaactttccgtgacgcaggttcgcgtggaaggcgacattaaatccaccgatcagatcgccgggaaactcgacgtacgcgttgagcaaatttcgcagccggatgtaaatatcaacctcgtcaccctgaatgccaaaggcagcgaaaagcagcacgagctacagttgcggattcagggcgagccggtttccgggcagcttaatctggcaggaagttttgatcgcaaagaagaacgctggaagggaactcttagcaatacccgcttccagacgccggtcggcccgtggtcgctgacccgcgatattgcgctggattaccgcaataaggagcaaaaaatcagcatcgggccacactgctggcttaacccgaatgcggaactgtgcgtgccgcaaactatcgatgcgggtgccgaagggcgtgcggtggtgaatctcaaccgcttcgacctcgccatgctgaaaccgtttatgccagaaaccactcaggccagcggtatcttcacgggtaaagcggatgttgcctgggacaccacgaaagaggggctgccgcagggcagtatcaccctttcggggcgtaacgtgcaggtaacgcaaaccgtcaacgatgcggcgctgccggtggcgtttcagacactgaatctgacggcggaattgcgtaacaaccgtgccgaattgggctggaccatccgcctgaccaataacggccagtttgatggacaggtgcaggtgaccgatccgcaaggccgccgtaatcttggtggcaacgtcaatatccgtaacttcaaccttgcgatgataaaccccatctttacccgtggggaaaaagcagcggggatggtgagtgccaacttgcgtctgggtggtgatgtgcaaagcccgcagttgtttggtcagcttcaggttacgggtgtggatatcgacggcaactttatgccgtttgatatgcagccgagccagcttgcggtcaactttaacggtatgcgctcgacgcttgccggtacagtacggacccagcagggtgaaatctacctgaacggtgatgccgactggagccaaattgaaaactggcgggcacgagtaacggcgaaaggcagtaaagtgcggatcaccgtgccgccgatggtacgaatggatgtatcgccagatgttgtattcgaggctacaccaaacctgtttaccctcgatggtcgcgtggatgtcccgtgggcgcgcatcgtggtgcacgatctgccggaaagcgcagtaggcgtctccagcgatgtggtgatgcttaacgataacctgcaaccggaagagccgaaaacggcgtcgattccgattaacagtaacctgattgtccacgttggcaacaatgtgcgcattgacgcctttggcctgaaagcgcggctgacgggcgatcttaacgtcgtacaggacaaacaagggctgggcctgaacgggcagatcaacatccctgaagggcgcttccatgcctatggtcaggatctgattgtgcgtaagggtgagttactgttctctggtccgccggatcaaccgtatcttaatattgaagctattcgtaacccggatgctacagaagacgacgtaatcgccggagttcgcgtcactggtctggcggacgaaccgaaagcggagatcttctctgacccggcgatgtcgcaacaagctgcattgtcttatttgctacgtggacaagggctggagagcgatcagagcgacagtgcggcaatgacctcgatgctgattggtctgggggttgcgcaaagtggccagattgtgggtaaaatcggcgagacgtttggcgtaagcaatttagcgctcgacacccagggagtaggcgactcctcccaggtagtggtcagcggctatgtattgccaggtctgcaagtgaaatatggcgtgggtatatttgactctatagcaacactcacgttacgttatcgcctgatgcctaagctatatctggaagccgtgtctggtgtagaccaggcactggatttgctctatcagttcgagttttagcaatgcgaatatttgtctacggcagtttacgccacaaacaaggcaacagtcactggatgaccaatgcccagttactgggcgatttcagtatcgataactaccagttgtatagcctgggccactatccaggcgcagttccggggaacggaacagtacacggtgaagtttatcgtattgacaacgccacgctggccgaacttgatgccttgcgcaccaggggcggtgaatacgcgcgccagttgattcagacgccgtacgggagtgcatggatgtacgtttatcaacgacccgtcgatggattaaagctaattgaaagcggcgactggttagacagggataagtaataataaaagcacgccaccttcgggtggcgttgttttttgcgagacgactcgcattctgttttgtaattccctcaccttttgcttttctctccgagccgctttccatatctattaacgcataaaaaactctgctggcattcacaaatgcgcaggggtaaaacgtttcctgtagcaccgtgagttatactttgtataacttaaggaggtgcagatgcgtattaccataaaaagatgggggaacagtgcaggtatggtcattcccaatatcgtaatgaaagaacttaacttacagccggggcagagcgtggaagcgcaggtgagcaacaaccaactgattctgacacccatctccaggcgctactcgcttgatgaactgctggcacagtgtgacatgaacgccgcggaacttagcgagcaggatgtctggggtaaatccacccctgcgggtgacgaaatatggtaaagaaaagtgaatttgaacggggagacattgtgctggttggctttgatccagcaagcggccatgaacagcaaggtgctggtcgacctgcgcttgtgctctccgttcaagcctttaatcaactgggaatgacgctggtggcccccattacgcagggtggaaattttgcccgttatgccggatttagcgttcctttacattgcgaagaaggcgatgtgcacggcgtggtgctggttaatcaggtgcggatgatggatctacgcgcccggctggcaaagcgtattggtctggctgcggatgaggtggtggaagaggcgttattacgcttgcaggcggtggtggaataaggtgtgtttatttatcgcgggcataaaaaaacccttactaaccgaagctcggcgttcagggttattgcgctagaagaacttatttattctttgcgcgctcgaaggaagcaacgatttcagctttagcggcttctgcgttttcccaaccttcaactttcacccacttgcctttttcgaggtctttgtagtgctcgaagaagtgagcgatctgcgctttcagcagctctggcagatcgttaacgtctttaatgtgatcgtattctttgctcagcttgctgtgcggaaccgcaaccagtttcgcatcttcaccggcttcgtcggtcattttcagaacgccaaccggacggcaacggatcacagaacccggctgcagcgggtacggagtcgggaccagtacgtcaaccgggtcaccgtccagagacagggtgtggttgatgtaaccgtagttgcacggatagaacatcgcggtggacatgaagcggtcaacgaacagtgcgccgctctctttgtcgatttcgtatttgatcggatctgcgttagccgggatctcaataacaacgtagatgtcttccggcagatctttacccgcagggacgttgagtaagctcatgtctgtttcctttaaaaatatgtggcaaacaagtgccgagtattatagccaactcgcgccgaatgtctttgcttgttttcgtcttcattttcctttttcgccagttttaagacggtatacagagcaggaaaatccataaccgtagccgcatttttcatagtgagatgaaagcgattacaaacttgtgattaacgttttatttacttttttgaagtgtgatgtaacgcaatccgttacataacgaattgtctatagttttttcgcgaacatcttttcaccaataataattaccccgacgaggacaaccctatgtggaaacgcttacttgtagtctctgcagtctcggcagccatgtcgtctatggcgttggccgctccattaaccgtaggattttcgcaggtcggatcggaatccggctggcgcgctgcagaaaccaatgtggcgaaaagtgaggccgaaaaacgcggaattacgttgaaaattgccgatggtcagcaaaagcaggaaaaccagattaaagcggtacgttccttcgttgcacaaggggtggatgcgatctttatcgctccagtggttgcgacgggttgggaaccggtattaaaagaggcgaaagatgccgaaatcccggtcttcttgcttgaccgttccatcgatgtgaaagacaaatctctctatatgaccaccgtcactgccgacaacatcctcgaaggcaagttgattggtgactggctggtaaaagaagtgaatggcaaaccatgcaacgtggtggaactgcagggcaccgttggggccagcgtcgccattgaccgtaagaaaggctttgccgaagccattaagaatgcgccaaatatcaaaatcatccgctcgcagtcaggtgacttcacccgcagtaaaggcaaagaagttatggagagctttatcaaagcggaaaacaacggcaaaaacatctgcatggtttacgcccataacgatgacatggtgattggtgcaattcaggcaattaaagaagcgggcctgaaaccgggcaaagatatcctcacgggttccattgacggcgtaccggatatctataaagcgatgattgatggcgaagcgaacgccagcgttgaactgacgccgaacatggcaggccccgcttttgacgcgctggagaaatacaaaaaagacggcaccatgcctgaaaagctgaccctgaccaaatccaccctttatctgcctgataccgcaaaagaagagttagagaagaagaaaaatatggggtattgagggttgctatgcctgatgccgattcgtaggccggataaggcgctcgcgccgcatccggcgatggtgcactgaagcctgatgcgacgcttaccgcgtcttatcatgcctactgggagcacgctttacaccgggggaaaccatgacgaccgaccaacaccaggagatcctccgcaccgaaggattaagtaaatttttccccggcgtcaaagcgttagacaacgttgatttcagcctgcgccgtggcgaaatcatggcgctgcttggtgaaaacggggcgggaaaatcaacgctaatcaaagcattaactggtgtataccacgccgatcgcggcaccatctggctggaaggccaggctatctcaccgaaaaataccgcccatgcacaacaactcggtatcggcaccgtctatcaggaagtcaacctgctacccaatatgtcggttgctgataatctatttataggccgcgaacccaaacgtttcggccttctacgccgtaaagagatggaaaagcgcgccaccgaactgatggcatcttacggtttctccctcgacgtgcgcgaaccgcttaaccgtttttcggtggcgatgcagcaaatcgtcgccatttgccgggctatcgatctctccgccaaagtgctgatcctcgatgaacccaccgccagcctcgacacccaggaagtggagctattatttggcctgatgcgtcagttgcgcgatcgcggcgtcagcctgatctttgtcactcactttctcgatcaggtctatcaggtcagcgatcggatcaccgtcttacgcaacggcagtttcgtaggctgtcgggaaacgcgcgagctaccgcagatcgaactggtaaaaatgatgctggggcgcgagctggatacccacgcgctacagcgtgccgggcgaacattgttgagcgacaaacccgttgccgcgttcaaaaattacggcaaaaaaggaacgatagcaccgtttgatctcgaagtgcgccccggcgagatcgtcggtctggctggcttgctgggatccggacgtaccgaaaccgccgaagtgatcttcggtatcaaacctgctgacagcggcacggcgttgatcaaaggcaaaccgcaaaccctgcgatcgccacatcaggcttcagtactgggcatcggattctgcccggaagacaggaaaaccgatggcatcatcgccgccgcctcggtgcgggaaaatatcatcctcgctctccaggcccagcgcggctggctacgacccatttcccgcaaagagcagcaagagattgccgaacgctttatccgccagcttggcattcgcacaccttcaactgaacaaccgattgaatttctctctggcggcaatcagcaaaaagtgttgctttcacgttggctactgacccgaccgcaatttctgatcctcgatgagccaacccgcggcattgatgttggtgcccacgccgagatcatccgcctgattgaaacgctgtgtgctgacggtctggcgctgttggtgatctcctccgaactggaagagctggtgggctatgccgatcgggtgattatcatgcgcgatcgcaaacaggtggcggagatcccgctggcagagctttccgttccggcgatcatgaacgccattgcggcgtaaggagaacagtgtgatgcctcaatctctcccggacactacgccgccgaaaaggcgctttcgctggccaacgggaatgccgcagctggcggcgctattgctggtgctgctggtcgatagcctggtagccccgcatttctggcaggtggtgcttcaggatgggcgtttgttcggtagccctatcgacattcttaaccgtgcagctcccgttgcgttactggcgattggtatgacgctggtgatcgccaccggtgggattgatctctccgtaggggcggtgatggctatcgccggagccacaacggctgcgatgacggtcgcgggattcagcctgccgattgttttgttaagcgccctgggcaccggcatcctggcgggattgtggaacggcatactggtagcgatcctcaaaattcagccgtttgtcgccaccctgatcctgatggtcgccgggcgcggcgtggcgcaactgatcaccgccgggcagatcgtcacgtttaactcgccggatctctcatggtttggcagcggatcgctgttgttcctgccaacgccggtcattatcgcggtgctgacgcttctcctgttctggctgttgacccgcaaaacggcgctggggatgtttatcgaagccgttggtatcaacattcgggcggcaaaaaatgccggggtaaacacgcggatcatcgtcatgctcacctacgtgttgagcgggctgtgtgcggcgattgcgggcattatcgtggcggcggatattcgcggtgccgatgccaataacgccgggttatggctggagctggacgccattcttgcggtggtgattggcggcggatcgctgatgggcgggcgctttaacctgctgctctcagtcgtgggggcgctgattattcaggggatgaacaccggaattttactttctggctttccgccggagatgaaccaggtcgtaaaagcggtggtggtgctttgtgtgctgattgttcagtcgcaacgctttatcagtctgattaaaggagtacgtagccatgataaaacgtaatttgccactgatgatcaccatcggcgtctttgtgctgggctatttctactgcctgacgcagtttcccggttttgcttccacaagagtgatctgcaatatcctgacagataacgcctttcttgggataatcgccgttggcatgacctttgtgatcctctctggcggtatcgatctctccgtcggttcggtgatcgcctttactggcgtgtttctggcaaaagtggttggcgatttcggcctctcgccgctgctggcgtttccgctagtgctggtgatgggctgtgccttcggcgcatttatggggcttctgatcgacgccctgaagatcccggcatttatcattacgcttgcggggatgttctttttgcgcggcgtcagctatctcgtttcggaagagtcgattccgataaaccatcccatttatgacacgctctcaagccttgcgtggaaaatccccggcggcggtcgccttagtgcgatggggctgttgatgctggcggtggtggttatcggtattttccttgcgcatcgtacccgttttggcaatcaggtgtacgctattggcggcaacgcgacgtcggcgaacctgatggggatttctactcgcagcaccactattcgcatttatatgctctccaccggactggcaacactggcggggattgtcttctcgatttatacccaggccggatatgcactggcgggcgtaggtgtggaactggacgccatcgcgtcggtggtgattggcggtacgttgttaagtggtggcgtcgggacggtgcttgggacgctttttggcgtggcaattcagggactgattcagacttacataaactttgatggcacgctgagttcctggtggacgaaaatcgccatcggtattttgttgtttatttttatagcattacagcgtggattaacggtgctgtgggagaatcgtcagagttcgccagtgacaagagtcaacattgcgcagcaataaaaacgcctctccgtgtggagaggcgcaggagattacgcgtccgggaactcacggataaagcgttcgacatcttcaaccatatggtcgttgccgacaaagaacgaacggcgctggtgcagagtttccgggatgatatccagaatacgctctttgccatcgctcgctttaccgcccgcttgttccgccaggaatgccatcgggttgcactcataaagcaaacgcagtttgccgtccgggtggctggcggtgcttgggtagagataaataccgcctttcagcaggttacggtggaaatccgcaaccagtgaaccgatataacgtgaggtatacgggcggttggtggatttatcttcttcctggcagaatttaatgtacttcttcaccccgttcggaaacttaatgtagtttccttcgttgatggagtaggttttgcctttctccgggaagcgcatccgttcctggcacaggcagaaaacgcccagcgaaggatcgtaagtaaaggcgtgaacaccgcatccggtggtgtaaaccagcatggtagaggagccgtataccacgtaacctgccgcaacctgtttgttaccaggctggaggaaatcttcttccgttaccggcgtgccgacgggcgtaactcggcggtagatggagaaaatggtaccgacagagacgttaacatcgatgttggacgagccatccagtgggtccatcagcaccacgtattttgcatgttcacagccttcaaagacaacaatctcatcttcttcttcagaggcaatgcctgcaacgatatcgcgtgctttcagtgcggctttcagtttttcattagcgaacaagtcgagtttttgctgaacctcgccctgcacgttctcagcaccgctggcacccaggatatcaaccagtcctgctttgttgatatcgcgatggataatcttggcgcccagttttattgccgacagcaaagcagtgagctcaccggtagcatgagaaaactcgtgctgcttttcgacaataaattcacctaacgttttcataaaactttccctgcaatgtttatggagtaaagcgaccgcaacaatcttaacaaataatctcaatgttgcgctcaggtgaatcgcgccagcaaattacggattatcctgaaatgcgtttctcacttgcccgacatatgcgtaaaatgagcggcagattaaaaaaggatagtgacgtatgcgcattcatattttaggaatttgtggcacgtttatgggcggtctggcgatgctggcgcgccagttaggccatgaagtaacgggttcggacgccaatgtgtatccgccgatgagcaccttacttgagaagcaaggcattgagctgattcagggttacgatgccagccagctcgagccgcagccggatctggtgattattggcaacgccatgacccgtggaaatccgtgtgtggaagcggtactggaaaaaaacatcccttatatgtcaggtccacagtggctgcacgattttgtgctgcgtgaccgctgggtgctggccgttgccggtacacatggcaaaaccaccaccgcgggaatggcgacctggattctggaacagtgcggttacaaaccgggatttgtgatcggcggtgtgccggggaactttgaggtttcggcgcgtctgggcgaaagcgacttctttgttatcgaagcggatgagtatgactgcgccttcttcgacaaacgctctaaatttgtccattactgcccgcgtacgctgatcctcaacaaccttgagttcgatcacgccgatatctttgacgacctgaaagcgatccagaaacagttccaccatctggtgcgtatcgttccggggcagggccgtattatctggccggaaaatgacatcaacctgaaacagaccatggcgatgggctgctggagcgagcaggagctggtgggtgagcaggggcactggcaggcgaaaaagctgaccaccgatgcttccgaatgggaagtcttgctggatggcgaaaaagtgggcgaagtgaaatggtcgctggtaggcgaacataatatgcacaatggcctgatggcgattgcagcggctcgccatgttggtgtagcgccggcagatgccgctaacgcgctgggttcgtttattaatgctcgtcgccgtctggagttgcgtggtgaagcgaatggcgtcacggtatatgacgattttgcccatcacccgacggcgattctggcaacgctggcggcgctgcgtggcaaagttggtggtacggcgcgcattattgctgtgctggaaccgcgctcgaataccatgaaaatggggatctgcaaagacgatctggcaccttcattaggtcgtgccgatgaagtcttcctgctgcaaccggcgcatattccgtggcaggtggcagaagtggcagaagcctgcgttcagcctgcacactggagtggcgatgtggatacgctggcagatatggtggtgaaaaccgctcagcctggcgaccatattctggtgatgagcaacggcggttttggtgggatccatcagaaactgctggatggtctggcgaagaaggcggaagctgcgcagtaattcggcctcagcctgagatagcattgccggataaggcgtttacgccgcatccggcatttgagcatagtgcctgatgcgacgcttgatgcgtcttatccggcctacaggtgcaccgcatccggcaaaccatactcacatcaacaacgaaaattacccttcattctccgccagttcgcgcagatactggaaaatctggcgtgcggatttcggcggcttattcccttctttctctttcttcgcgttacggatcagagtacgcagctgctgacgatcggcatcgggccacagattcaatacttcagcgatggcgtcatcaccttgatcgatcagacgatcgcgcaggttttccagtttatggaacagcaccacctgctggttgtgacggtttttcagcttatccagcgcctgacgaataggctctacgtcgcgctggcgcagcatcttaccgatgagctgcaactggcggcggcgaccttccatcttaatacgctgggcgagctcaatagccgcgcgcagatccgcatctaacgggatcttatccagcgcgtttttccccagatcaacaatttccgcgccaaggcgttttagctcctcggcatcacgtttaatttcacttttactgacccagataatttcatcgtcttcgtcttcgatgtcatcaccgggaacgtcgtcgagccagtcttcgggctgcttagtcatctcaggctccttaaaaaaagaggctaatgttaccagttaagatgcgcactgaaaaacggttctctgttagacttcagagaaactctctacattatggcacttgcaatgaaagtaatctctcaagttgaagcgcagcgcaagattctggaagaagcagtttccactgcgctggagttggcctcaggcaaatcggacggtgcggaagttgccgtcagcaagaccaccggcattagcgtaagcacgcgttatggtgaagtggagaatgttgaattcaatagcgatggcgcgctggggatcactgtttatcaccagaaccgcaaaggtagcgcatcatccaccgatttaagcccgcaggccattgcccgcaccgtacaggcggcgctggatattgcccgttatacctcgccagatccctgtgccggcgtggcagacaaagagctgctggcctttgacgcaccagatctcgacttgttccaccctgcggaagtttccccggatgaagccattgaactggcggcccgcgcagaacaggcggcattgcaggcggacaaacgcattaccaataccgaaggcggcagttttaacagccactacggtgtcaaagtttttggcaacagccacggcatgttgcagggttactgctctacgcgtcattcactctccagctgtgtaattgccgaagaaaatggcgatatggagcgtgattacgcctacaccattggtcgtgcgatgagcgatctgcaaacgccagagtgggttggggccgactgtgctcgccgtactttatcgcgcctgtcaccgcgtaaactctccaccatgaaagcgccagtcatttttgccaatgaagtggcaaccgggctttttggccatctggtgggggcgatagcgggtggctcggtttaccgtaaatctacctttctgctggattcgctgggtaaacaaattctgccggactggctgaccattgaagagcatccgcatctgctgaaagggctggcgtcgacgccattcgacagcgaaggtgtgcgcaccgagcgtcgcgatattattaaagatggcatcctgactcagtggctgctgaccagctactcggcgcggaaactggggctgaaaagcaccggacatgcgggcggtattcacaactggcggattgccggacaagggctaagcttcgaacaaatgctcaaagagatgggcaccgggctggtggtgacggagctgatgggccagggcgtgagtgccattaccggtgattattcccgtggtgcagcgggcttctgggtagagaatggcgaaattcagtatcccgttagtgaaatcaccatcgcaggtaatttaaaagatatgtggcgcaatattgtcaccgtcggtaacgatattgaaacacgcagtaatatacagtgtggttctgtgctgttgccggagatgaaaatcgccgggcagtaaaaaactggcgcgacctgccgcgctataaactaaaaaattacacaaaatcattcgcactgcatcgagacggaaagtgaatgagggccggggagcgtactcgcagtacgtgacccgggcgaatgagcgtagccgtcgatgaggcagtgtgaaggatgaagtgtaaataaaaaaggaagtgagcaatgcgtaaaagcctgttagctattcttgcagtctcctcgttggtattcagttctgcgtcgtttgccgctgatcttgaagacaatatggaaaccctcaacgacaatttaaaagtgatcgaaaaagcggataacgcggcgcaagtcaaagacgcgttaacgatgatgcgcgccgcagcgctggatgcgcaaaaagcaacgccgccgaagctcgaagataaatcaccggacagcccggaaatgaaagatttccgccacggtttcgacattctggtcggtcagattgacgacgcgctgaagctggcaaatgaaggtaaagtaaaagaagcgcaggctgctgcagagcaactgaaaacgacccgcaacgcctatcaccagaagtatcgttaattcctcatttccctgttgcctgcactcaggtaacagggaacttatcatcgcaaatgatgcaccacctgattgctgctgccgcgccagatcagggaagggtcttttaaatcctgcacaaatttgccgtcgaccagcacgttaatcaaatcaacaacctgcatttgcgcagcgttgagttcgtcgagtttatagcctgtccacacccagatgtctttacccggacactcggcgcggatgcgttttaccagtttcagaatatccggcacgttttgcggatgcagcggatcgccgccggagagggaaatcccctggcgtttgatacgagtgtcattcagatctttaatgatcttgtcttccattgctttggtaaatggctgaccagaatttacccgccatgtgcttttgttatagcaaccggggcattcatgaacacacccggagacaaacagggtgcagcgagtgccggggccgttgacgatgtcgacaggatagtactgatgataattcattatttcgcctggcttatcagtccgcgtgtaggctgcatccggtaatcaatgcctgatgcgacgctgtcgcgtcttatcaggcctacagccgttgccaaatgtaggccggataaggcgtttacgccgcatccggcatttgcttagcgcagagtgaagattaacctatctgcccattccccaaatgtttaacgcggcgcttaacttcttcctgcttaccagcgttaaacggacgtgcatccgggctacctaaatatccgcacacgcggcgagttaccgacacacgggaggcgtcatggttaccacatttcgggcaagtgaagcctttgctggtgcactcgaactcaccggtaaagccacactcgtagcactcatcaatcggtgtattggtgccgtaatacggtacatgctgatagctgtaatcccagacatcttccagcgctttcaggttgtgctgaatgtttggatactcgccgtagcaaatgaaaccaccgttcgccagcggcgggtaaggcgcttcaaagtcgatcttgtcgtacgggttcaccttcttctccacatcaaggtggaaactgttggtgtagtaacctttatcggtcacgcccggcaccacgccaaactcagcagtatcgagacggcagaagcggtcgcacaggttttcactcggcgtgctgtagagactgaaaccataacccgtttcttctttccactgatccactgcctgacgcagacgttcaacaatggcgatacctttcgcgcgaagctgctcgttgtcgtaaacatgctcgccgccgaacagcgcgttaatggtttcgtggatgccgatgtaacccagcgaaatagacgcacgaccgtttttgaagatttcagaaacatcatcgtcagcattcagacgtacgccacaagcaccttccatatagaggatcggggcgacgcgcgctttcacgccttcgagacgagcgatacgggtcatcagtgccttacgtgccagcaccagacgttcatccagcagcttccagaaggtggcttcatcgccttttgcttccagagcaatacgcggcaggttcaggctgatcacgccgaggttgttacgaccatcgtggatctgctcgccgttttcattttcccacacgccgaggaagctgcggcagcccatcggggttttaaacgaaccggtgactttcactacctgatcgtagttcaggatatccggatacatgcgcttgcttgcgcactccagcgccagctgtttgatgtcgtagttcggatcgccttttttatggttcagaccatcgcgaatcgcaaacaccagtttcgggaacaccgcagttttacggtttttaccgaggcctgcgatacggttacgcaggatcgattcctgaatcaggcgcgattcccagctggtgcccagaccaaaaccaaaggttacaaacggcgtctgaccgttggcggtgtgcagggtgtttacttcgtactccagcgactggaaggcatcgtagcactctttgatggtacgagagttagcgtagccttcggcgtccgggatgttccactcttctgcggtcttgcgatgtttgttgtagctggcggtaacaaacggcgccagcacttcatcgatacggttaatggtggtgccgccataaatatggctggcgacctgagcaataatctgcgcagttaccgcggttgccgtagagatcgacttcggcggttcaatctcggcgttccccattttaaagccctgggtcagcatgcctttcaggtcgatcaacatgcagttgaacatcgggaagaacggcgagtaatcgagatcgtgatagtgaatatcgccacgctcatgtgcctgcaccacgtcacgcggcagcaggtgctggcgtgcatagtgtttagccacgatcccggccagcaggtcgcgctgggttggaatcaccttgctgtctttgttggcgttttcgttgagtaacgaggcgttggtctgctcgaccagaccacggatctcctggttcaggcgaccgcgtttttcacgttcaatgtcgcgatcgtgacggtactcgatgtaagcacgagccagttgtttgtatggacccgacatcagctggttttcaactgcggtctggatctcgttgatatccacctggttgcggccctgcatctgctcgctgacaaccgcggcaacagtggcgcaataatcggcatcatcgacttccgctgctttagctgcacgcagaatcgcttctttgatgcgctctgatttaaacggcactttgcagccgtctcgtttcatcacatgcggtgtcatgatcgctccatatttttaagaacaggttatccacagaaattgggaaaggcgttttccggttttttcgtttcgttttccggtgctttccgcaatcgccatccgcttatccacaacgccgcacctttttcgtggggagctgtagtagcaattatagtcgattaatacaacatattgggttgggacgcattttaaagtctatatatagtgctttgcatcaaggatgtttgaactttttttgatgtagctcaaagtaaaaagcagagcgtacggatgacgggcgctacagcgttatgtaaattttttaatgaatttgctggttgaaaaatcaacaaaaacaacatgctgacagacaaaaccccggaatgaccggcattaccggggcttagggaagatttacttctgtaaccaccagacagcctcaaaaggccgtaaattcatggcacagggttgtggtgaggcttcttcgtagttatgcatcacaagctgccagttgccgcgcatttgccctggctgccagggttggatctcacggctaaggttggcaatgaccagcaaggtttgccccttccattcacggcgatagcaccacaatacagggctgtttggcagcagatcctggtaattgccccatgtcaggatggcttcttgcttacgcagtgcgattaacttttggtaggtgtaaaacaccgaggactcatcggccagcgcggcttctacgttgatttgttgatagttatcgcccaggccaatccacggttcgccagccgtaaacccggcattatcgccgttgctccattgcatgggcgtgcggctgttgtcacgggatttactggcgaggattgccaataactcgtcggcatcacgaccatcgttgcgcagctcggcaaacatattgaggctctccacgtcgcgatagtcagtaatgcgcgtgaaatgcgggttggtcatgccaatctcttcgccctggtagatatacggcgttccctgcatgccatgcagcaccatcgccagcatttttgccgcaggcacgcggtattcaccttcatcaccaaagcgagaaacaatgcgcggctgatcgtggttacaccagaacaaggcattccatgccacgttgtgcattccttgttgccagtggcggaacaatgttttcaacgccacaaagtcaggtttagccagcgtccatttttcaccaccgggataatcgaccttcaggtgatgaaaattaaaggtcatcgacaattcactgcctgtcagtgccgcgtatcgctggcaatgctcaaggctggtggaggacatttcacctacggtcattaacccgcgtggcgtaaacacatcgcggttcatctcgtgcaaaaactcgtgtgctcgtggcccgtcggtgtagaagcgacgcccgtcgccatccaggtcttcagggaaacgcgggtctttggagatcagattcaccacatccaggcgcaacccgtcgaccccacgatcggcccagaattcacagacttttttcagctctgcgcgtaccgctggattctcccagttgagatccgcctgttctggtgcaaagagatgcaaatagtactgttcgctttccgcatgccagcgccacgcactaccgccaaattttgaacgccagttgttcggtggcgtttctggttcgccatcgcgccagatataaaactggcggtaagggctttctttgttcagcgcctcgcgaaaccaggcatgttgggtagaggtatggttaaacaccatatcgagaatgatacgaatcccgcgcgattttgcctgcgtcaccagttcgtcaaaatcgtccagcgtgccgtagatgggatcaatcgccgtatagttcgctacgtcgtaaccgttatcgacctggggagagatataaaagggggttagccagatggcatcaacgcccagtttatgcagatagtccaggcgttggataacgccacgtaaatcgccggtgccgctacccgtggtgtcctgaaaactctttggataaatctggtagataacgccgttttgccaccagtggggaagattagtcattacgttattcctgcaaatgcgagggggcgcaattgcgccccgaagaaaattaaacaatatccagcgtgcccaggcggtatttccgctgatagataaacgaggtgagtacaatcgggatgatgatggcgataaccattgccagcgcaaatacctgccagtagctcggttgaatcgagagaattcccggcaggccgcctacgccgataccattcgccataacgccgttcaggccgcatagtaatcctgccagaccagaaccaatcatcgcgcacagcatcgggaagcgatatttcaggttgatgccgtacattgcaggctcagtgaccccaagccaggcggagatagcggcaggcacggagatctcgcgttcattgtgcttgcggctggaaatgataatgcctatcacggcggagccctgagcgatattcgacagcgcaatcagcggccacactggcgtgccacccatgctttgaatcatctgcaaatcaatagcaagggtggtctggtgtacgccggtgatcaccagcggcgcgtacaggaagccaaacaatgccgcaccaatcggagcaaagctgccggtcatcaggtgacgtaccgcaaaggcaacgccatcgccaatcatgcgaccaaacggaccaatcagcgcatgggcgaggaacaccgcgaggatcagcgaacagacgggcaccaccaccagatagaggtaatccggtacgatgcgtttaaggcgagtttcaataacgcccagcgccagcccggctaacagtgccgggatcacctgcgcctgatagcccactttggcgatgctgaacatgccaaagtcccacacttccggcagctgctgcccgagcagataagcgttcatcagctggggggaaaccagtgtcacgccaagcacgataccaaggatcggcgtgccgcccatttttttcaccgctgaccagcaaatcccgaccggcaggtagaagaagatcgcttcaccgatcaaccacagaaaatcgtagatcgtttgcagggaagggtacatttgcgccagcgtttgaccgttgctcatgggcaaatcgccgatcacattgcgaaaaccgaggatcaaaccgccgctaatcaacgcgggcagcaacgggaagaagatctccgcgaaatgagagatcaactgctcatgccatttcatattctgccgggcggctttttttacctgctctttatcaacctgcgcctgtccggttgacgctattagtgcttgatagtaatcacccacgttggtgccaatcaccacctgaaattgcccggcattggtgaaacagcctttcaccatggggagttgctcaatttctttcggtctggcattggccggttggttgaggacaaagcgcaggcgagtaatacagtggctcaccgtcgcaatattgccgcgcccgccgaccagttcaatcaaccgatcgatatccgtttggtttattttgctcatcataaagccccatggcagatgacatttttggttggctgcagaatatattgcgcggaaaaatttaaaaacgggaacgttcccgaaacgcagcgaagatcacaatttatcgttcaggaaacgatcaggacagggtggcggggatgatgatttgttgcggttcgctgcgcccggttacctgtgcgatcaattggcaggccgcctggcgtccagcttcggcgtaaccaggatctacggtgacgatctccggatgaaggaatttcattaatggcgtattaccgacgctcgccagttgcaaggtgtcgatgcgttgctcttgcaggtatttacttgcgccaagtgccagcgtgtcggttgcgcacagtaaggcggtagtttcaggcgtaatcacttttgccacgttctcatagccttgcttcatagcaaggcctggcagagcggcaacgggattcagtttatgcgctttgcagaacgccaggtaggcttcgtgacgtcgcttcccggtcgtcacgtcactatgcggcacgccgagataactgatattacgatgcccctggtcatacagccgttgcatcaggatcttgattgccccttcgtcgtcataacagaccgaagcaaaaccttttgcgtcacgcgccagcagaaccagcgatgactgccagtgggctaacatttcttctgttatgccagtaaaaccgaacagcactacgccgtcgatattacgccgtttcagcacccccaaatgttcggcaactaattgcggggaaaactgactttccatcatgattgggtcgtaaccttgttcatagaacgctggcagcatggtttgaacggcgagattttctgacaacgaatccaggcgggtaacaatgatggcgaccactttatcgctttgcccacgcatagcgcgcgcagagcgggaaggggaaaatccatgctgattcatcactgcttcaacacgctcgcgggtgcgctggctcacgccgctttcgttattcagcacccgggaaactgtagatttccccacgccgcttaagcgtgcgatgtctttgatggtcagccgattttgcatcctgttgtcctgtaacgtgttgtttaattatttgagcctaactttacccgtgcattcagcaatgggtaaagtctggtttatcgttggtttagttgccagcaggtattatatcgccatagatgctacgaatattattggattctccttattatttgcggcgcttttttcacttaccggaggttatatggaacctgatcccacgcctctccctcgacggagattaaaacttttccggtaagcccgtcttttcacggcgttaccggatgcgtaaggccgtgacgttttaacgtccctgctcagctttattaccttcaggtaaggcttcgccacgcctgaagacatttctgtactgtttcagacagtgcggagggactccttatgtttaaagaaatttttacccggctcattcgccatttaccttcccgtctggttcatcgcgatccattgcctggcgcgcagcagacagtgaatacggcggtcccgccgtccttaagtgcgcattgcctgaaaatggcggtgatgcccgaagaagaattatggaaaacgttcgacacccatccggaagggttaaatcaggcggaagtggaatctgcccgcgaacaacatggtgaaaataaattacccgcacaacaaccgtcgccgtggtgggtacatttatgggtctgctatcgcaacccctttaatattttactcaccattctcggcgctatttcttacgccacggaagatttatttgccgcgggcgttattgcgctaatggtcgctatttcaacgttactgaactttattcaggaagcacgttccactaaagcggcagatgccctgaaagcgatggtcagcaataccgcgacggtgctgcgcgtaattaacgacaaaggcgaaaatggctggctggagatcccgatcgaccagctggtgcccggcgatattataaaactggcggcgggagatatgatcccggcagatttacgtatcttgcaggcgcgggatctgttcgtcgctcaggcgtcgttaaccggtgagtctctgcccgtggaaaaagccgcgaccactcgccagccggagcacagcaatccgctggagtgtgacaccctgtgttttatgggcaccaccgtggtgagcggcacggcacaagcaatggtgattgctacaggtgccaatacctggtttggtcaactggcggggcgtgttagtgagcaggaaagcgagccgaatgcctttcagcaagggatcagccgcgtcagtatgctgctgattcgctttatgctggtgatggctccggtggtgctgttaatcaatggttacaccaaaggcgactggtgggaagcggcactgtttgcgctttcggtcgcggtaggcttaacgccggaaatgttgccgatgattgttacctcgacgctggcgcgcggcgcagtaaagctgtcgaaacagaaagtgatcgtcaaacatctggatgctattcagaactttggcgcaatggatattctgtgcactgataaaactggcaccctgacacaggacaaaattgtgctggagaatcataccgatatctccggtaaaaccagcgaacgcgtgctgcatagcgcgtggttgaacagtcattatcagaccggacttaaaaacctgctcgatacagcggtgctcgaaggtacggatgaagagtcagcgcgctcgctggccagtcgttggcaaaaaattgatgagattccgtttgatttcgagcgtcgccggatgtcggtggtagtggcagaaaataccgagcaccatcagctggtttgcaaaggtgcattgcaggaaatcctcaatgtgtgttcgcaggtgcgtcacaatggcgagattgtgccgctcgatgacatcatgctgcgtaagattaagcgggttactgatacgcttaatcgtcaggggctgcgcgtggttgcggtggcgacgaaatacctgccagcgcgtgaaggagattaccagcgggcggatgaatccgacctgatcctcgaaggatatattgctttccttgatccgccaaaagagacaaccgctccggcactgaaggcattaaaagcgagtggaatcaccgtaaaaatccttactggcgacagtgagttagttgcagcgaaagtgtgccatgaagtggggctggacgcgggagaggtggtcattggtagtgatattgaaacgctatctgacgacgaactggcaaatctcgcacagcgcaccacgctgtttgcccgcctgacgccgatgcataaagaacgcattgtgaccttactgaagcgcgaagggcatgtggttggctttatgggcgatggtattaatgatgcgcccgccttacgcgctgcggatatcggcatttctgtggacggcgcggtagatattgcccgtgaagcggctgatatcatcctgctggaaaaaagcctgatggtgctggaagagggggttattgaaggacgtcgcactttcgccaacatgctgaaatacatcaaaatgacggcgagctccaacttcggtaatgtgttcagcgtgctggtggcgagtgctttcttgcccttcctgccgatgttgccgttacacttgcttattcagaacctgctgtatgatgtgtcacaggtggcgatcccgtttgataacgtcgacgacgagcaaattcaaaagccgcagcgttggaatccggcggatctggggcgctttatgatcttcttcggaccgatcagctcgatcttcgatattctgacgttttgcctgatgtggtgggtattccatgccaacacgccggaaacgcaaacgctgttccagtcgggatggtttgtggtgggcttactgtcgcaaacgctgattgtgcatatgatccgcacccgccgtgtgccgtttattcagagctgtgcatcgtggccgttaatgatcatgaccgtgatcgtgatgattgtcgggatcgcattgccgttttcaccgctggccagttatctgcagctgcaggcgctgccgttaagctatttcccgtggctggttgcgattctggcagggtatatgacattaactcagttggtgaaaggattttatagccgtcgttacggctggcagtaaagaataaactgggcacgatagccccgattcagattgcagacaaagtaagctttgttcatgccggatgcggcgtaaatgccttatccggccaacaaattcaataaattgcaggaatcacgtagatactgttatggcctgcaagttttttcctggtccggtttcccggattgcaggcatgccagacacagcgccgtcaggcgctgtttttttcatcccttccgcgatttttacgccgctaccggattatgccgtgacgcatcgaacggcacgcctgacttcagcactccatacgccacctgtgccagcttgcgcatcatcgcgccgagaatcacctttcctttcttgccattagccgccagacggtcgcggaacgcccgtccccactcagtcttactggtggctaccattgcgggcatatacaacgccctgcgaagcgacacatgtccggccttactcatccggctcgcccctctcacactgctacctgattcataacgccgtggtgtcagacccgcaaaagcggcgaactgtctggcatgggcgaagcggtccttcagaccgatataagccagcaataccgcagatgttttctctccgatacccgggatgctttccagcagtttcctgcggtgtttcatatccggatcatcgtctgtcaggtcttttatctgcttctcaagacgcttcagctctgcttcaagccacagaaggtgagcatcaatgctcggtctctggacttcccgcgccgtttcagtgcgattcagttcctgcgtgtgcatatctgtcagcgcctggtggcggactaccagggcacgcaacgcgcgttcaagcgggtgaggcgcttcccaggctgcagggcgcttctgacgacagaactctgccagcatgcgcgcatccacggtatcagtcttgttacgcagtccttcactctgagcgaaagctttacccagcgcaggattaatgactgacactatgtagccagcatcgtaaaggcactcagcgacaggttccatataggtgccggtcgcttcgatgcagatatgcgcatggtcaatcttgtgacctttcagccagctcaccagctcatcgtgccctttagtggtgttagcgaattttttggtgcgatgacgaccatcaggacgcaacacatcgacatccagtttctctttagcggtgtcgataccgatataatgaagttcatgttccatagtgaaaccaaccttgcaaatacggattaccgggaaaaccggtccatgatactgtccggtttatcactttgggagaaaggcagtccgctgcataaatctacgcaacaggttagaacccaaggcccgatacggcatgcggactgcaggcagagaaaactggccgattttctctgcactggagggataatacaaggcctgataagcgtagcgcatcaggcgattttgcgtttgtcatcagacttaatccgggcatgatagcccggatttccatcaagattagcgacgaacagcgatcgcttcgatctcaatcttcacgtctttcggcagacgggcaacttcaacgcaagaacgtgccgggaaggtggcattgtgttcggtgaagaaggcttcgtaggtagcattaacggttgcgaagtcgttcagatctttcacaaacacggtggttttaacgatgtcgcccactttcaggcctgcggcttcgacgatcgcttttacgttatccagcgactgacgtgcctgtgcagcgacgtctgccggtacttcgcccgttttcggatttaccgggatctggccggaggtgatgatcatattgcccagatcaacgccctgtacgtaaggaccgatagctgccggtgcattttccgtcgcgatagttttgctcatgatttctcctttattacagcggtaaaaagtctggctcattatagggagccagacttttattaccaaccgcaattaattggccagcaccacattatgggaaaactctttttcacagtatttgcatttgagcgcgatgtcattggcgcgttttcgcacggcaaagctggaagaaaccggttcggcatggctgatacagttgctgttcgggcagaccagcacattgtcgatgcgctctggcagactggggcgcgatttacccaccacttcatagttgtcgatacggttaaccgtggcttgcggcgcatacaatgccagttgatctacctgatcttcactcaaaaaggtattttcgattttgatcagatctttgcggcccatctcgccagaaggcaagttcagaccgatggtgatgcgctgatccgtttcggtcagcttgaacagactcaacagcttaaaaccgatctgggcggggatatggtcaattaccgtgccgcgtttaatagcttcaacctgcaatttattatcgtgtgtcatctctatttccccttacagtaccagatcgcgattcagaaccagtgccagtaacgcctggcgagcgaaaatcccgttgcctgcctgctggaagtaccaggcgtgtggcgttttatcaacatccgtcgcaatctcatcaacacgcggcagcggatgcagcactttcatattggctttggcgttgtggagatcgctggcgcgaagaacaaactgcgctttcacgttggcgtactcggacgggtccagacgctctttttgcacgcgggtcatgtacaggatgtctacttccgccatcacttcttcaatagagctgtgcagactccatgcgatccctttttcatcgagcatatccagaatgtattgcggcattgccagcgcgtccggcgcgatgaagtaaaaacggttgccgtcgaacttcgctaacgcctgagtcagggagtgaacggtgcggccatatttcaggtcaccaaccattgcgacgtggagattgtccagacgcccctgggtttcctgaatagtgaataagtccagcaaggtttgcgtcggatgttggttggagccatcaccggcattcagtaccggtacattgccggaaaactcggtggccaggcgcgccgcaccttcctgcggatgacgcatcactatcgcatcgacgtaagtgctgataaccgaaatggtatcggccagcgtttcgccctttttacccagtgatgtattggcgctgtcggagaagcccaccacgctggcacccaggcggtgcatagatgtttcgaaagagaggcgggtacgggtagaggcttcgaagaaacagctggcaatgactttgtgcttcaacagctctggttgcgggtttgctttcagtttcgccgctgtcgccagcaccagattaaggtcatcgcgactaaggtcgtttatggaaatgatatgtttctgatatagcggattagccatcttttatctcctgacgcctgggcaaaaaaaagcccctcgattgaggggctgggaatgggtgatcaacgggaagaaaaacggcaggccagcgtcttttttcagacgcggtaagacaaaatgtcgaacacactgaaccatacatcctcccggcaaattgtccggcattatactcatcgtcagaagcggtgcaagcatttgatgcaatattttgtcagcgcaaacggtttatttgaattaaaagtcaaggtatatgcatttttatttgatgtgattctgcaggggaactgtccttcggtatcaataattgcagacattccctgctttttcctttttcactttcacgcaatcagatatgcattttattccattcatccgacttatagggcggagtgtgaaaacgaacggctaacactattgcttactgctcagggatgcgcgctatcactttaatttcaaaatcaaagcctgccagccatgtaacacccaccgccgtccagtttggataaggtggggcgctaaatatttcatttttcaccgtcatgatgtcttcgaattgtttttctggatcggtatgaaagctcgtaacatcaatgatatcgtcaaaagtgcatcccgcagcagccagggtcgcatgcaaattatcaaatgccagtctgacttgttgctgaaaatcgggttctggtgttccgtcctctcgacttcctacttgcccggaaacaaacagcaaatcgccggagcgaatagccgcagaataacgatgttcagcatacagtgaatgtcggccagcagggaaaacagcggttctttctaccatttggttatcctcaagatttacgacatgaacagaagatttatatttaccaggagccgcttttagcggacgacgtgagtaaacaaaacccagacatcatgggaaatggctgggcttaattgagcgtagtcggttatgcgccaaacgcgccatcaatggtatgcatcgcgccggtaacaaagctggcttctggccctgctaaccatgcgaccataccagcgacctcttccggttgcccatgtcttttgatagccataaaaccatgcaacatatcgcgcattggcccgttggcgggattagcgtcggtatcaattggccctggctggacgacgttgatggtgatcccacgcggtccaaaatcacgggccagcccgcgcgccatgccttgcagggcagatttgctggcggcataagcagccatgcctgcaacaggcatacgatcgccattcacggagccgatgattaagatgcgcccgccttcgggcatctgccgggcggcttcaacggaggcatggtaaggagcatgaatattgattttgaaaaggcgatcaatatcgtcggcatttaattccagggcatcgccaaagacgccaatacctgcatttaccacgaggatatccaatgcgccgctcttacgaacgacatcaataacagcgtctctgtcagcactatctgtgaatactgctgtcgctcccgtctcttgtgccaggcgttcagcggcatctttcgaccccgcataggtgaatcgtacattggccccatcggtgacgaaacgacgtacgatagcggcaccgattccacggctaccaccgaggatgagaactgtcttacctgtaaaagcgcccataaggactccttgatttattatgtaacatgcattacaaaactgttttaactttctgtcaacaagttttgtaatggtcactaaaaaacaatctcgcgttccaggtcgtcccagacgtttcgctcctgagcaggcagtctctgcggcaaaagtgctttttcaccaaaaaggtttcgatgctgtcagtgttgctgaagttactgattatcttggtattaaccccccgagcctctacgcggcttttggcagtaaggctgggttatttagccgtgtactcaatgaatatgtcggtacggaagctattccgcttgccgatattcttcttgatgatcgtccggtaggcgagtgcctggttgaggtattaaaagaagcggcgcgcagatatagccaaaacggcggctgcgctggctgtatggttcttgaaggtattcatagtcatgatccacaagcgcgtgatattgccgttcaatattatcacgccgcagaaacgaccatttatgactatatcgccaggcggcatccacaaagcgcacaatgtgtgactgattttatgagtaccgtgatgtcagggctttctgcgaaggcacgggaggggcactccatcgaacaactctgtgcaacagctgcactggcgggggaagcgataaaaactattctcaaggagtgatgcgggccttgacccgaaaggcgggaacgcgcctgccgataagttgtgataagacaataattcacgcgttaaggctagcggaattgatcatcttttcgtataacgatagaaatgaaacgttgttttaattaaggagtggaaaagatgatcatcggaaatattcataatcttcagccgtggctaccccaggagttacgccaggcgattgagcatatcaaagcacacgttacggtagaaacgccaaagggcaagcacgatatcgaaggcaatcgtctgttttatcttatctcggaagatatgaccgagccgtacgaagctcgccgtgcggagtaccatgcccgctatctcgacattcagattgtgttaaaaggtcaggaaggcatgaccttcagcacacaacctgcaggtacgccggataccgactggttagctgataaagacatcgcatttttgccggaaggcgttgatgagaaaacagttatccttaatgaaggtgattttgttgtgttttatccgggggaagtgcataaaccgctgtgcgcagtgggtgcaccagcccaggttcgcaaagcagtagtgaagatgctgatggcgtgatgacttttcgccgtaaataactccaggtttacggcgagtttgtgaaaagagcgttttttgatattttttgtgagtaaaatttgtaatgcttagacgttcttattaactcaaggagtccgtcatgagcaaaatatcaggttggaatttttctcaaaacattacatcagccgacaattgtaaacaaaaaaatgaagacttagatacctggtatgtgggaatgaatgattttgcccgaattgccggagggcagaatagcagaagcaatattctttctcccagagcatttttggagtttttggctaagatatttaccctgggttatgtggattttagcaaacgctccaacgaagcgggtagaaatatgatggctcataataagtcctcatcttatatcaaaaataatgatggtagtgagataatgaagtttgttatgaataatcctgaaggggagcgagcggatttatctaaggtggaaatagaaattacacttgcctcagcttttaataatgggattcgtgaaggacatacagtcattatatttacacaacctgatggttcgactaatcgttatgaagggaagtcctttgaaagaaaagatgagagttcattacacctgattactaacaagattctggcgtgttaccaacgcgaagctaacaaggaaatagctcgtctattaaatattccgcaggagttaaataattctcaggacttgaataactcgcaggtgagttgtaaagattcagttgattctacgattacggatttattagaaaaaccattgaataatgcattattagcaataaggaaagaacatctgctattaatgccttatgtatgtaatgaatcgatttcatacttgcttggtgaaaaagggatactgaaagaaatagatgaccttaacgcagtaaataattatcttcttaataataagaaagctactgacaatgaaattaatgacatcaaagttaacctgtctcatattcttattgattccttagatgatgcaaaagttaaccttacaccggtcatcgattcgattctggagacttttttaaaattcccatatattaatgatgtaagaatactggattggtgttttaataaaagaatgcaatattttggcgattctgaaaagataaagtatgcatgctccgtgataaatcatattgattttagccgcgatcaatctaaagattttagctgcgatcaatctaaaattaaaatagctgagaccttatttttcaatctcgataaagaacactataaaaatagccgtaaattacaggaattgatttgggataagttggttgcatatgtcaatgattttaacttaagcaatcaagaaaaatcacgcttaatactaaggttatttgatgatgttaagttgctatttaatgaagtgcctgtcagtattttagtaaatgatattttttttgaaggattttttcatgaagcaacctgattttgctaagtggtatttctatcaattacttaaagattatgagggcgaacagctgtatcttaatgagttaggatatgtttatggtaatgaagaaaaaacaaatgaaattgtaaaaagcaatccgggttatgtcgttaagatttttgaagaaaagatggttaatgaattaaaaattagaacaagaatgatgaaaatcctccggaagatttacgtatagcaatagaaaaatatggatggaataattgaactattactgcataaaataatgtgatgccgggatgtttttgtatttcccggcatctttatagcgatatcaattatttactgagcgtcgcgaccatcaccgctttgatggtatgcatgcggttttccgcctgatcaaaaacaatgctggcggcagattcgaagacctcatcagtcacttccattccgccatgtaggccaaactcttccgccattttcttaccaagcgtcgtctggtcgtcatgaaacgcgggcaggcagtggaggaatttgacctccgggttaccggtcaactgcatcatcttgctgttcacctgataatcacgcagtaatgcaatccgttctgcccatttctcttttgcttcccccatcgacacccatacatcggtatagataaagtcagcaccttcaactcctttggctacatcttccgtcagcgtaatattcccgccattttgctgtgccagggcgcggcattccgtaaccagcgcagcttccggccagcatgcctgtggcgcgaccagacgcaaatccagaccggtaagcgccgcagcttcgagcatcgaattgcccatgttgttacgtgcgtcacctgcatagaccagcgtcatttcgttgaatgctttaccgggtaaatgctcctgcatggtgaggagatccgccagcaactgcgtggggtgaaactcattggtcaggccgttccataccggcacgccagcgtattccgccagtgtttcgacaatctcctgaccatagccgcgatactgaataccgtcatacatgcgacccagcacgcgggcagtgtctttaatcgactctttatgaccaatctgactgccgcttgggccgagataagtaacgcgagcaccctggtcatatgcggcaacttcgaaagagcatcgggtacgggtcgagtctttttcgaagatgagcgcgatgtttttaccagtgagtttggcttcttctttgccgcttttcttatcggctttcagcttcgcggctaactgcagcaggctgttgagttcagctggcgtgaaatcgagtaatttcaggaaatgcttatgataaaacccggacatagatccctcctgtggctaacgccttaatgaattaaaattcaatttatatggatgattattcatttgcaagtctaaagcataaatctttgtcacaaaggtggaggcaatgtcagtggtgtgtgacaataagagtatcggcaggacattaagaggaatgagccatggcaaacccggaacaactggaagaacagcgtgaagaaacacgtttgattattgaagaattactggaagatggcagcgatccggacgcgctgtacaccatcgaacaccatctttccgcagacgatctggaaaccctggaaaaagcagcagttgaagcgtttaaactcggttacgaagtgaccgatccagaagagctggaagttgaagatggtgatatcgtgatttgctgcgacatcctcagcgagtgcgcgttgaatgccgatctgatcgatgcccaggttgaacaactgatgacgctggcggagaaatttgacgttgagtacgacggttggggcacttactttgaagatcccaatggcgaagacggcgacgatgaagattttgtcgatgaagacgatgacggtgttcgccactaattaattgattaaaatgcccgatagcacacactagcgggcatttttttagagttcgcgtagcatccgcacttcacaatcgacatggcccgtgcagccaagcgcatagttgatatgctcaaagcccaaatgctcataaagcgcaatggcttcctttaaaaaagcggtcgtttccagatagcagcgtttgaagcccatctctcgtgcctgctccatcgccattaaggccagttttttcgccagccctttaccgcgaatagccggaagaaaatacatcttttgcagttcgcaaatgtccgattcactcccggttaatggcgcaatcccaccgccgccgaccacttcaccatcgaactcaaccacccaatatgcatggccaggctgactatacacttgatacaactcgtcaaggttcggatcggcgacggtgtagcctttatcagcggtaagaccgtattcggcggatacctgacgaatgacgcgggcgatagcgggattatcctgctgcgtcaggcgacgcattacaggtgattgcggcgcaatgttattcatagtttaacccaataaaaataaagtaattatacatttgtttaataccactctcttcttacgtgcgcaagcgacttataaagtaataaagtttttgccagcctattactgataagagtattgtaacgtggcagaacattttgctgtctgtatatataaattatatcaatggattttttaattcagggaatttttatggctcaagttattaatgaaatggatgttccgtcccattcgtttgtttttcatggtacaggtgagagatattttcttatttgtgtggtgaatgtgttgttaacgattataacgctaggtatctatttgccatgggcattaatgaaatgtaagcgttatctctatgctaatatggaagttaacggacaacgattttcttatggaattactggtgggaatgtttttgttagttgtcttgtttttgttttttgctatttcgcaatcttaatgacagtgtcagcagatatgccacttgttggctgtgttttgactttgttactgttggttttgcttatatttatggcagcaaaaggactgcgttatcaggccttgatgaccagtctcaacggcgtaagatttagttttaattgctctatgaaagggttctggtgggtaacctttttcttgccgattttaatggccattgggatggggactgttttctttatctcgacaaagatgctacatgccaatagttcaagtagtgttattatatctgtggttctgatggcaatagttggtattgtttccattggtatttttaatggtactttatatagcctggtaatgagttttctctggagcaataccagtttcggtatacatcgtttcaaggtgaaattagatactacgtattgtataaaatatgccattctcgcatttttagctttattaccttttctcgctgttgctggttatattatcttcgatcaaatattaaatgcatatgatagttctgtgtatgcaaatgatgatattgagaatttacagcaatttatggaaatgcaacgtaaaatgataatcgcgcagttaatctattattttgggattgctgttagcaccagttatttaacggtgtcgttgcgaaatcattttatgagcaacctgtcactgaatgatgggcgtattcgttttcgctcaactttaacgtaccacggtatgctttatcgcatgtgtgcgttggtggtgatatccgggattacgggcggtctggcttatccactgctgaaattatggatgattgactggcaggcaaaaaatacgtatttgctgggcgatttggatgaccttcctttaatcaataaagaagaacaaccagataaaggcttcttagccaggatttcacggggaattatgccttctttaccatttctgtaagagataaaaaaggccggagcatgctccggccttcgttttcattactgtgttttgattacagcgcggcgataacagcctgctgttcaatcagcttcgctttcgcttctgcatagccttccagcttttcacgctctttcgcgatgaccgcttccggtgcgcgggcgacaaagccttcattcgccagcttgttctcgatacggctgatttcaccttcaatcttcgccacttctttcgccagacgcgccagctcatcttctttgttgatgaggccagccatcgggatcagcagctctgcaccgtcgatgatcttagtaacggaaaccggacctttgtcatcggcaggcagcacggtgatgctttccagacgcgccagcgtttgcaggaagccacggttttcatttacgcgacgttctgcatccgcgctgcaaccacgcagtagcagctccagcggtttgcccggcgcgatgttcatttctgcacggatgttacgtaccgcaacgatcgcctgcttcagccactctgtgtcggccagtgcggcttcatcaacctgagatgcatcgtactgcgggaacggctgcagcatgatggtgtcggcagtgataccgcaaagtactttcacacgctgccagatggtttcggtgatgaacggaatgatcggatgcgcgaggcgcagcagaccttccagcacggtcaccagcgtatggcgagtaccgcgcagttcggcttcggtgccaccgttcattaccggcttagtcagctccagataccagtcacagaactggttccaggtgaactcatacagaatgcctgcggcgatatcgaagcggaagctgtccagcgcttcgcggtacgctttgatggtctggttgaactccgccagaatccagcgatccgccagcgacagcgtcatctcgccgccgttgaagccgcaatcctgaccttctgtgttcatcagcacaaagcggctggcgttccacagcttgttacagaagttacggtaaccttccaggcgcttcatatcccagttgatgtcacgaccggtagacgccagtgccgccagggtgaagcgcagggcatcggtgccgtgcggctcaatgccgttcgggaactgtttctcggtgcgcttacggattttgtccgccagctgcggctgcatcatattgccggtacgtttttccagcagttctggcagcgaaataccgtcaaccatatccagcgggtcgataacgttacccttggatttggacatcttctggccttcgtcgtcacgaatcagaccggtcatgtaaacagtgtggaacggcacctgcggtttgccattttcatctttgatgaagtgcatggtcatcatgatcatgcgggcaatccagaagaagatgatgtcgaaaccagataccatcacgctggttgggtggaactgacgcagggcgtcggtgttttccggccagccaagggtagagaaggtccacagcgcagaagagaaccaggtatcgagaacgtcttcgtcctgacgcaggacaacatcagcaccgaggttattttctttacgcacttcgtcttcgttgcggccaacataaacgttacccgcttcgtcataccatgccgggatacggtgaccccaccacaactgacgagagatacaccagtcctgaatatcgcgcatccaggagaagtacatgttttcgtactgcttcggtacgaactgaatgtcgccgttctcaaccgcttcaactgccggtttcgccaggacatcggcacgcacgtaccactggtcggtcagcattggttcgatgaccacgccgccacggtcgccgtaaggaacggtcaggtcatgtggtttaatttcttccagcaggccgagtgcgtcaaccgcagcaacgaccgctttacgtgcagcaaaacgctccagtttctggaattctgccgggatctcgctggaataaacgtcagattcgttacctttggtatcgaacacctgggcactttcacggatatcgccgtcaaaggtcaggatgttgatcatcggcagggcgtgacgtttaccgacttcatagtcgttaaagtcgtgcgccggggtgatcttcacgcagccggtgcctttttccatgtcggcgtgttcgtcgccaacgatcggaatacgacggttaaccagcggcagaatgacatatttgccaatcagatctttgtaacgcggatcttccgggttaacggctacgccagtatcgcccagcagggtttccggacgggtagtcgcaaccaccagataatctttaccgtctgcggttttcgcgccgtcagccagcggatagcggatgtgccacatcgaacctttcgattcgcggttttccacttccaggtcagagatagcggtgcgcagtttcgggtcccagtttaccaggcgcttgccacggtaaatcaggtcttctttatacagacgaacgaaaacttctttcaccgcattggacaggccttcgtccatggtgaagcgttcacgctcccagtccacggagttgccgagacggcgcatctgacgggtaatggtgccgccagattccgctttccattcccagattttgtcgatgaaagcttcgcggccgtagtcgtgacgggttttaccttcttctgcggcaatcttgcgctcaacgaccatctgggtagcgatcccggcgtggtcagtaccgacctgccacagggtgtttttgccctgcatgcgctgatagcggatcatggtatccatgatggtttgctggaaggcgtgacccatatgcaaactgccggtgacgttcggcggcgggatcatgatgcagaaactttcctggctttcatcgccattaggcttaaagtagccctgcttttcccagtgctcgtaaagcggctgttcgatatcttgtgggttatatgtcttttccattatttccaggttgccgtattcaggttgaaaccagccacgcggtaggctttatagcgttcgcgcgccagttgtttcagagaatcttcataaggaacgaagtctaccacttctgtgaaagcggtggcaaaatctgcaaagcttgttcgcagactaatcaatatatcgcgcgggctgctgctgcgtttttgcggccaggcgatctccaccggcgcaccgccgcgcggtccttctcccgctaaattatgcggaacaaagctttctgccggacgcgcccacagggcttcatccagccggtaagcctgcttttcatcttcacaggcgatgagtacgcgcttaccactgcgccaacgttctgcggcaatttcacacaccagttgctcaacggcgcttaagccatcgacggtggtgtcattgtccagaaggtagaacgtcgcgtttttcataaatggggcttcttgtggtggatttaaatattgctgcattcctcaccctaaaagatgagcaatgaatttctattgcgctcgatcggttccctctcccttagggagagggttagggtgagggtaaaacgcaaacttactcttcgccgttaaacccggcgcggtttaacaggaactgtgccagcaacgctaccggacgaccggttgcgccttttgctttaccagaacgccaggcggtaccggcgatatccaggtgcgcccagttgtacttacgggtaaagcgtgacaggaagcaacctgcggtaatcgccccaccaggacgaccgccaatgttcgccatatcggcaaaattggactccagctgttcctgatactcgtcacccagcggtaagcgccatgcgcggtcaccggattgttcagacgcggcaatcagctcatgggccagcggattgtggttcgccatcagaccggtaatgtgatgacccagcgcgatcacgcaggcaccggtcagcgtcgccacgtcaatcaccgcttccggctcaaaccgctcaacgtaagttaacacgtcgcacagtaccaggcggccttcggcgtcggtgttcagcacttcaacggtttgaccggacatggtggttaacacatcgcccggacgataggctcgtccgccaggcatgttttcgcagcctgccaacacgccgataacgttaatcggcagttgtagctctgcgaccatacgcatcacgccgtaaaccgctgccgcaccgcacatatcgtacttcatctcatccatgccttcggaaggcttgatcgagataccgccggagtcgaaggttaaacctttacccaccagcacgattgggcgtgcatcttccgacgcgttgcctttgtactcaatcaccgacatcagcgattcgttctgcgaaccctgaccgaccgccagataggaatgcatccccagctctttcatctgctgttcgccgataacgcgggtgatgacattcttgctgtagctgtcagccagctggcgcgcttgtgaagcgaggtaagcggcgttacagatattcggcggcatattgccgagatcttttgctgctttaatcccggcggcaatcgccagaccgtgctggatcgcgcgctcaccgctggtcagttcacggcgggtcggcacgttgaacaccattttacgcagcggacgacgcggttcgctcttgttcgttttcagctgatcgaaactgtagagcgtctcttttgccgtctcgacagcctgacgcactttccagtagttgttacggcctttaacgtgcagttcagtcagaaagcagaccgcttccattgagccagtatcattcagcgtattaatggttttctgaataacctgcttgtactgacgctcatccagctcacgttctttgccgcaaccaataaggagaattcgctcggaaagtacattcggaacatggtgcagcaacaatgtctgccccggttttccttccagttcgccccgacgtagcagggcgctgatgtacccatcgctgattttatcgagctgttctgcaatcggagaaaggcgacgtggttcgaagacgcccacgacgatgcaggcactccgctgtttctccgggctaccgctttttacactaaactccatgcactacgctcctgaatcttaaagacaacggcggtggctacagatagaattgcaagctttcgtaactcatgtccgctgttgcgatgacttcgtgttaatcttaacgttattacggcattggcacgtcagaacaaaatctgagaggtgaatccgttgagtataattatcttagcgacgatttcgacgactcaagagaataaatgacgtttaagccatgaaacaagctaaaatcctgcaaaagacgagtttttacgggcgtatttaaagtgataatcataagatatctggtgcgggagacgctcaaaagccagctggcgatactcttcatcttgcttttgatcttcttctgtcaaaagttagtgaggatcctcggcgcagcggttgacggcgatattccggcgaatctggtgctctcccttctcgggttgggcgtgccggaaatggcgcagcttatcctgccattaagcctgttcctcgggctgctgatgacgctgggcaaactgtataccgaaagtgaaattacggtaatgcatgcctgcggcctgagcaaagcggttctggtgaaagcggcaatgatccttgcggtattcacggcaatcgtcgcggcggttaacgtgatgtgggcgggaccgtggtcatcgcgtcatcaggatgaagtgttagcagaagcgaaagcgaaccctggcatggcggcgctggcgcaagggcaattccagcaagcgactaatggcagttcggtgctgttcatcgaaagcgttgacggcagcgatttcaaagatgtgttcctcgcgcaaattcgaccaaaaggtaatgcacgtccttctgtggtggtggccgattccggacatttaacccagctgcgcgacggctcccaggtcgtcactctcaaccagggaacgcgcttcgaaggcactgcactgttacgtgatttccgcattacggatttccaggattatcaggcgatcattggtcaccaggcggtggcgctcgacccgaacgataccgaccagatggacatgcgcacattgtggaacactgacaccgatcgtgctcgcgcagaactgaactggcgtatcacgttggtgttcaccgtgtttatgatggcacttatggtcgtaccgctgagcgtggttaacccgcgtcaggggcgcgtactatcgatgctgccagccatgctgctgtatctgttgttcttcctgatccagacctccctgaaatcgaacggcggtaaaggtaagctggacccgacgctgtggatgtggaccgttaacctgatttatctggctttggcgattgttctcaacctttgggacaccgtgccggtccgccgcctgcgcgccagtttttcgcgtaaaggagcggtgtgatgcaaccttttggcgtacttgaccgctatatcggtaaaactattttcaccaccatcatgatgacgctgttcatgctggtgtcgctgtcgggcattatcaagtttgtcgatcagctgaaaaaagccgggcaggggagttacgacgcgttaggcgcaggaatgtataccttgctgagcgtgccgaaagatgtgcaaatcttcttcccgatggcagctctgcttggggcgttgcttggtcttgggatgctggcgcagcgcagcgaactggtggtgatgcaggcttctggtttcacccgtatgcaggttgcgctgtcggtgatgaaaaccgccattccgctagtcttgctgacgatggcgattggtgaatgggtcgcgccgcagggcgagcagatggcgcgtaactaccgtgcgcaggcgatgtacggcggctcgttgctctctacccagcaaggcttatgggcgaaagatggcaacaacttcgtctacattgagcgggttaaaggtgacgaagagttaggtggcatcagcatttatgcctttaacgaaaatcgtcgtctgcaatccgtacgctatgccgctactgcgaagtttgacccggaacataaagtctggcgtctgtcgcaggttgatgaatctgatctgaccaatccgaaacagatcaccggttcgcagacggtgagcggcacctggaaaaccaacctcacgccagacaaactgggcgtggtggcgctggacccggatgcactctcaatcagcggtttgcacaactacgtgaagtatctgaagtcgagcggtcaggacgctggacgttatcagctcaacatgtggagcaaaatcttccagccgctatccgtggcggtgatgatgctgatggcgctgtcgttcatctttggcccactgcgtagcgtaccgatgggcgtgcgtgtggtcaccggtatcagcttcggttttgtcttctacgtactggaccagatcttcggcccgttgacgttggtttatggcatcccgccgatcatcggcgcactgttgccaagcgccagcttcttcttaatcagcctgtggctgttaatgagaaaatcgtaatctaatgaacgcataaagggagcgaaagctccctttcacattgttgataaagtcaaatacgagttcgatcggtcctctcgcccctttggggagagggttagggtgagggggacagatcgcgcctgacttaccttcttctcccccccagcaaactccccaacattccacgcacaatctgattcgtcacctggcgagcggcgcttttggccattgtttgcaccacaccatctttcttcccgccgcgtggtccggtagtgccgaacaaaatatccttcaatccaccaagaatgccgtcatccaccgctacctctttccctttcgcggggggattattttgctgctcggtactggcctgaaagcctttttgcaacatctcataggcggattcccggtccacctcatcctcatatttgccatacaccggagagtgattaatcaagccattacgctcatcttccgtcaccggccccatccgcgaacaaggcgcgatcaccatcgcacgctccaccacagaagggcttcctttcgcatccagaaaagagatcaacgcctcgccggtgcccagttcctgaatcgccttttcggtatcaaatgccggattggcccgcatggtttgcgccgcagcttttaccgctttctgatctttgggcgtaaaagcacgcaaagcgtgttgaacgcgattaccgagctgcccgagcacattatccggaatatcagacgggttttgcgaaacgaaccagacgcctacgccttttgagcgaataagccgtatcacctgctcaatcttatccagcagtacctgcggtgcatcgttaaacagcagatgtgcctcgtcgaagaaaaacaccagttttggtttctccagatcgcctgcttccggcaattgttcatacaactctgaaagcatccacagcaggctggcggcgtacagtttcggcatctgataaagcttctcggcgctgaggatattgataacgcctttaccgttggtatcggtgcgcatccagtctttgatatccagcatcggctcgccaaagaagtgtgctgcgccttgctgttccagcgacaacagtccgcgctggatggcaccaaccgatgcgctactgatattaccgtactgattctggaaagatttggcgttatcgccgatgtactgggtaatcgcccgcagatctttaaagtcgagcagcaacaatccctgatcgtcagcaatacggaagatgatattcagcacgccagattgcacatcgttgagattcaacagccgcgccagcaacagcggccccagatccgaaaccgtcgcccgcaccggatggcctttctcgccaaagatatcccacaccaccaccggattggcatgcggttgccagtcattgacgccgatatttttaagccttgcgagcagtttttccgacgccgttcctgcctgcgcgataccggtcagatcgcctttcacatcagccataaacaccggcacgccgatttccgacaatgactccgccagtttttgcagcgtaacggttttacccgtccccgttgcgccagtaatcagcccgtgacggttagccattcccggcagtaaaaacagttctgtgtccggcgtgcgggcaattaacaggggttcgctcatgagatttcctccagtttcctgcctggagtataggcaacgtccggcaaagagaatacgtgtaatgaagagaaaataacctaaagcgtgttgccttgataaatctgatacccgaggtcaacagtgttgtggttgtgatcgttatttttaattttgctcagcaacatttgggcggccatccgaccaatatcaaaacggggagtaattacgctggcgaggcttgggatcatttgcctgccaatctccagcccatgaaaacccgcaatggaaatttgttctggcacggcgaggtttcgctcgcggcacagcagaagcgcacccatcgcaatatcgtcattggtgcaaaatacaccgtctaaatccgggtttgcgctaagggcatcacgcattaactgcattcctaaatgaatggatgagatggcgcgtggattcatgcgtaatggggaaagattatgcagcatcatcgcatcgcaatacccctgataacgctgttcatcgcgggtgtcatctttggaaccgagatacagaattttgtgcctgactcgcttctccagcatggtacacaccatgtcaaaagcggcctgccgattatcaaaaccgacctccatatccagccgttctccctgtacatccatcaattccacgaccggaatggtggctgaacgcagaaatttcaccgtcctgatggtgtgatatttttccgaaagtataatcccgtcaatgttataagagagcaggttaatcaccgactcttcttcggaatcgcgatcgtaattgtaattagcaataagggtctgataattatgctcagaggtgacggattctattcccgcgagaatgtcagcgaagagttgattttgaaatgacggaatcaagataccaagggtataactttgtgcattcaacaacatgccgggagcgcgattagggatataattgatctcttccataattttggcgatgcgctcgcctgtttcctttgccacctttttcggcgagcggatataacgactcacggtcatttttgttacgccagccagcgtagcgatatcctgtaaagaaattctgtgattgcgcataacttctcccaacgtcgggggaatcttcaatcttcccccgaaactacatcacaatattttattctttcagtgcaatacggcgttaatggctaacacgcccagcaaacccataatagaaataagggtttccatcaccgtccaggtacgcaacgtttcaccaaccgtcagattaaaataccctttaaatagccagaagccagggtcgtttacgtgtgacgcgatcacgctgcccgcaccggttgccagtaccattaaagcgggatcggcatgggtaacgttgataatcggcaacaccacacccgcggtggtaatggccgcgacggtggcagagcccagagcgatacgcaacagcgccgcaacagtccagcacatcaataacggcgaaagcgtagttccggtcattaagtgtgaaatatagtgcccgacaccgctatctactaatacctgcttaaacgcgccgccgccagcgataataaacacaatcatcgcgatagcgcctatagaatccccaatgatatccatgatttgctcgatggtgcgtccattacgtcggcccagtgtgaaaatcgcaataacaatggcaataaacagcgcaacggcagggttaccgacaaattcaaagaagaggcgcacggtgttagttttcggtaacgtaatttcacaaacggcggcgatagccatcaggatgaccgggatcacggcagcgaaaatactgttccagaaggagggcatctcctcttcgctaaacagatgaggattaaataagccttccggtggtgctttctcaaagcgagttagcagtttagaaaacagcggtcctgcgacaataactgtcggaatggtaatgataaatccatacagtaaagtcgttccgagattagcctcaaagatagtcgcgatggcagtaggccctggatgtggcggcagaaaacagtgggttacagagagcgctgctaccattggtacgccaacatacaacaggggtaatcctgatgatgctacgatggtaaataccaacggcaacagcaggacaaaacccacttcaaaaaacatggcgaggcccacaaccagaccggtgatcactagcgcccattgcacgcgttttttaccaaaagtagcaatcagcgtagtggcgatacgttgtgccgcacccgtatcagaaatcagcttgcctaacatggccccgaaaccgagaatcattgccagcccgccgagcgtgctgccgataccattttgtatagagtgcaggacggcctgtgcatccatcccttcggcaaatccgacgacggcagctaccagaacgagggcaataaagccgttaactttaaagccgatcatcaggataagaagcagcgcgacgcctgccgcaataatgattaatggcatagtctttatctcttattagtgccagaaaagcagcgctttcgcgctgcacgtagggtagtaggtgttaaacagccactaacatgccgccatcaacaaacaacaggtggccgtttacgaaatcagaggcttttgaagaaaggaacaccgcagcaccaatcagttcctgcggatctccccagcgtgcggcgggggtccgtttgcacaaccaggcggtgaaggcttcgtcctcaaccagtgctttagtcatttctgttttgaaatagcccggcgcaataccgttgacctgaatattgtggcgcgccagctcgacgcacatgccgcgggtgagcatttttaccgcccctttcgatgcggcataaggggtgatggtgtcacgtcccagttcgctttgcatcgagcaaatattaataactttacctgccttgcgttcaaccatgtgacgagttaccgcttgcgataccaggaacacggcggtctggtttactgcgatcacatcattccactcttgttcagggaactcagtaaaaggatgacggcgctggataccggcgttattcaccagcacatcaatggggccgatgtccttttcgatatgttcaacggcggcatcaatttcatgtttatgagtaacattaaaaggtgcggcaacggcctgaataccctcctggtggagtttttctacagcaagttctgcgcgttcggcagtaatatcattaataattatttgtgcgccatatttacccaggccggttgccagtaaaaagccaatgccctgtgctgaaccggtaatcaagatattttttcctgccagtgaaaatagatcgttcattgtattattcctttatttatctcttagaaaacaagctggacttttgctgcctgggttttatcaccggcgaaacgtagcgcctcttccaggtcagtgaagggatattcagcactcagtaaaggcagtggattgataacgccattcgccagccatgacactgcggtattaaattcgctggtaaaacggaaagagcctctgagtgaaatctccttaccaatcaacgtcatcattgggaattctgccatcgcgcctcccatacctacctgcaccattacgccgcgtgcacgagtgacctccagacaggtattcactgatgaaggatgaccggacacttcaaagctgacatcgaaatagcctttttccgctttccagtgatccatgtcgtcgttttgtgggtttacgagcacatccgcccccatctctttgcccagcgaaagggaacggggactcacatcagcacagacaatttccgcggcccccagtgttttcactgcactgacaatcaggcagccaatgggtccaacaccggaaataaatactcgcttgccctgtaactcgccggcctgatgtgcggcatgaatcgcgacggctaaaggttcggcaaaagccataaccttttcgtcagctttggccggataagggacacattgcgacgtttcgaccattttataacgggtaaaaccaccatcaacatgagggaaatacatggcactgccaaaaaaacgcatctctgtacactgattctcgttatgttcaatgcagtatttgcagtgaccgcacggtttagacggattaatggctaccgtttgcccttcatgtaattctgatgagtcgctatgaataactttaccgataacttcatgacctaacaccatcggtgcctttatcatgaaattacctacttttccttcctgataataatgtaaatcggaaccgcaaattccacctcgggttatttgtactaatgttccattattattccaatctatcgtctgctcggtaacggcaacagttttcttgcccgcaacaacgcaggactgtgttttcacttgcataaattcctcactggtcaggtagacacctcggaagcatttaagcggttttaattgtcattatttgtgatgaagatcacgtcagaaaattgttacattactatgttacgcataacgtgatgtgccttgtaattcttatcagcagaaataaaaaaacgtgaaattattatgccaccaggcgtagtatcgcagcaggtaagatgattcaggagattttaaatggcgggtgaaagctttattttgatgggcgtttcagggagtggtaaaacattaattggtagcaaggttgccgcgttattatctgctaaatttattgatggtgacgatcttcatccagccaaaaatatagataaaatgtcgcagggtattccattatctgatgaagatcgacttccctggctggaacgcttaaatgatgcttcatacagtctttataaaaagaatgaaacaggatttattgtctgttcatcattaaaaaaacattatcgtgatattttacgcaagggtagcccccatgttcatttcctctggttagatggcgactatgaaactatcctcgcgcgaatgcagcgtcgggctgggcattttatgccggtagcgttactaaaaagtcagtttgaggcgctggagcgtccacaagcagatgaacaggatattgtgcgcattgatatcaaccatgatattgccaatgtcaccgaacaatgtcggcaggctgtgctggcgatacgacaaaacagaatatgtgcgaaagagggcagcgcctcagatcagcgctgcgaatgattttcaaaaatcggctttcaacaccacgcggtaacgcgccttaccgtcgcgcacatgctggatggcgtcgttaattttcgacatcgggaacagttcggttgtcggcgcaaccttgctgcgggcggcaaagcgcatcagcttacgcagttcataaggcgtgccggtagcagagccagagacgctgcgatcgcccgcaattaacgtaaaggccggaacagacagcggcgtgagaaccgcaccgacagtgtggaaattaccgccgtacgtcagcgcctcaaaataaggctgccagtcgaggctgacgttcacggtattgataatgagatcaaactgccccgccagtgctttcagtgcctgcggatcgcggctattcaccactttatcggcacccatcgccagcaattcctgctctttcgccggattagaactaaaggccgtcacctcacatcccattgcgtgcagaagttttatagcgatatgccccagcccgccaataccaattaccccaacgcggctggtagcagtgatatggtgcatcaacagtggtttaaagaccgtgataccgccgcacaacagcggcccggcagattcaatgtcgatattttccggcagtggaataacccattgccagtctacacgcaacttctcggcaaaacctccgcgattcataattgttggcaccgcaccttgctcacagttgatctgatttccgctaatacaggcgtcgcagtgaccacagctacgcgctgtccagccaatcccgacacgctgaccgacctgcaaacctttatcctgcgcggcactcccgagcgccaccacgcgaccaatcacctcatgcccggcaaccagcggatattgtgaaaatccccattcgttatcgatcatcgacagatcggaatggcagatcccgcagtaatccacctgcacttcaacatcttgtggcttcagctcaccgggatcgtactcataaacttccagttcgccgcccgcttcttttgcggcatagctttttatcattgacattttttggtccttctctggtgtggtctgggaagtgtagagcatggcagggcggggtgcatggagtgtgacaaaggttacacatcgctgtacgcaatgctgaaaatttcagcacttagcgagatgcgagcaagctggcgcttgcatggtggcgtgcgacaggtataatccacaacgttttccgcatacctcttcagtgccgaagtggcgaaatcggtagacgcagttgattcaaaatcaaccgtagaaatacgtgccggttcgagtccggccttcggcaccaagactcaattaaatccttcttttttaaggattttttgtttctagaccttaatatcgcgttgccctactacaaaagggtatacgaggcgatgtcccagcgttataacctctatcgtcgaaccagcggcatttatgttgtccgcattagcgttccccaacgttttcgtcgatacgcaggacagtgtgagattcacacttcaacaggcactcatgatcttcatgaagcaaagcagaagtccgcgctcctgttggctgtctggtatcagaccttacaagagtatgaacaattggattaccgaactttaagtgactgcgccccgctgcttgctggtgaggggatgatctcgctttctaactttgctcagtcaatcgagttgcctatatcgcaattgattcgagaggtgattaatcgtaacctcccggtattctggctggcgactggtcagttcggtttctatgttgatgaatttaatgcagtagagcgggaacccggtgcaaaacgagaaaaacagtctgatgatgaaaaggatcaacctaaagaagtcatcattctcaatagcgcgtttgagctgggtatcgagagcttcgcaaatggttatctccgccccttcaatccccggcatactttagattgtctgttgagcgctggagtatccgaaggagaggctgcatttcgaactagtggtgataaccaaagtggaggttggttcttcgatttacccggcgtagatataactgctgatagcctcttgattagcaaagttcatgctgaaggccttcgacttacatggctggttaagaccacgccaccagcagttagcattcaccctgccgtgcctcttgtcgcccctgttatcgctaacgaatatgttcaccgcaaacattacaatgaaaacttgtcatggcttcgtgaagagtatttgaaacatcggcgtaagggcaaggtatcagaagcggcgctccgcgatattcgctattacttcgatttgatgatcgaagtgatgggggatattcagttggaagatttcgaccgtgatttcctccgggcttatgagagcaagttgcgcacaattcctgctaaccgtaatttgatgaaaggtaagcacggggttaagacgctggatgagttaatcgccaaagcggcagaatgtggcgataaactgatgacagaagagtctgtcaaaaagtatatcaacggcctttatggtgcaatggagtgggctgttgatgacggtaagtttctgaaatcgccatgcgacaactttttccctcccgatgacaaaggtgagcgagagcaggatcacactgacatatttgaaccgcatgaaattaaggcaattttttcgcaaccgtggtttgtggctggaactgttgaacgtaatgcgcaagggcgattccatcaatattgcccgtttcactattgggcgccgttgttgggcttgatgacgggggcaagggttaacgagattgcacagttaatgctggacgatgttctggcagatgacggcgtttattacctgaaccttgaaagcgatagcgaaaacggaaagaaactaaaaaacgcccaatcccgccgcaagattccggttcattctacgctgattgaactcggttttatcgagtatgtggatgcgttgaaagctgccgggtatgaccgtctttttcccgagcttaaaccacataaaactaaaggctatggtaggccggtttccgcatggttcaatgaatcattgcttgcgggtcgattaaaacttgaaagagacagaagcaaatctttccactctttccggcattctgtttcaactttgcttaaagagaagggtgttagttcggaactgcgtgggcagctacttgggcatgtgcgcggcaaaacagaaactgaagtgcgatacagcaaagatttaaaaccggttcacatggttgaggttgtcgaaaagattgatttttctttgcccgagatagcgagattcaacattcctgatgggctggatgctgtaagtgatgcgctgcgaagaaagcgtggcaaacaaacaggttgagtcagttactattcagttgagtgatgctcctgaatgcgctgggacgcttcctagcgcattttttattaaagatcgtggatttaatagtgccaaatttggagacgcttaaaatgcgtctggtgagacttgatttgcattagctcagaattgatctgacagttttctctgacagcatacaatcaagtctatcagtccgccttgagcgaggagcggaaactaagcgcttcgatagggccgtagcatgttatgaaggagaaagctgctttacagaaagaatctatcaagcattctttctcagcaacaataactgaataaattttacttcgaaggagccaatattattcaatattaatttcttcttcccacgccaatccattttctatatgagcaagcttctctgaaaatgatctgattatttcagatatgtcagagtcaacggatgcagtttgaacagaaatcattaactcttggctgaggcttctaatatattcttcggtcgataaactttgacagtgctctactatagaactcattgctaactgaacatgtttcctaacggattcatgttcaattttgaatgagtcaatatttttaggtatgtaacttaatggcgggttaaataaaacgttaaaccttgaggattttcctgctgtaggatttaagcacaagcatttaggtgatatactcgaatgattacctaaaataatagagaaattaaatgcaccaaaaagctttatataagcaaccaattggtgatttacattagttataaatacagtgtgttcaaaaccacattgaatggcgtctggggttttttcgtgtgggtgtaaatttgtaatgacaggaaaatcatttgtatagtcccatccgcaatattttgtaatgtcaggttctccacttcgtatggatcccctaaggctctgatagatatcggttcttgctcgcgaattgccatacaaaacaacataggagactacagcaattttcgctatagcacgaaaaatcttatttccttcaaacttaatgctagctcttataacaggagccttagttgtaacatattttgcattaatatcccctatattaaggccgcgcttcttaagaattcctacaatcctattagcatcacctacatcttgagcaacgaaatcaaagactgtattgctatcagtttcatcttttgagggtattcttgacttagacacaataggtgtcaagtttggtgcgagatcatacttgatgccatcatcaaactgacctgcttcctttattgttggtggtgggtttcctcttccagaccaaacattcaaagcattcctgatataaataaagttatcagccagagcgatctcaaccgcatctgaactcgcttctgaaaataaattgttgcaacttttgcatgtcgcatgtgttgtggtaattcttccacctaacgcactagggaatacatgctctaggctacctttatcaaagggaatatcacaaaaaatacacttctctgggtttgtttgcatgtttatttaacttttctattaaaataagaatgttttaacttaccatcattgaactaatttgcatcattttttgtcgttaatcctagcaacacaacttgatacatgaaggactgaatcgccacggataatctagacacttccgagccgttgataatactggttttcatattctgtcggtgacatctgttcgctagaaccatgccgacgcttactgttataaaacatttcgatgtaatcaaaaatatcactgcgggcttcttcccgcgttccgtagatctttttctttatccgttcacgtttcaacaactggaaaaaactttctgcaaccgcattatcatggcagttaccgcgacggctcatgctaccctccaggccgtgtgatttcaggaacgactgccactcatggcttgtgtactgactgccctgatccgaatgaaccagcacctgtttttcgggattacgccgccatacagccatcagcagtgcgttcaggacaatgtcctttgtcatccgggattgcatggaccagccgataattttgcgtgagaacagatcaacaacaacggcaagatacagccagccttcgtgggtcctgatgtaggttatgtccgttacccaacgctcatcaggagcatccggattgaactgtcgctggagcctgttgggtgacacgatactggcctcgcctttacgtgcccgcgggcttcggtatccgacctgagcctttattccgacacgtttcatcagtctccagactctgtttactccgcactgttgcccgctgtcacgcaaatccagatggattttgcgataaccatagacgcatcccgattccagccagaactgtttaatctgtcctgtcagtctcaggtctgcctgatggcgttgtgaatgcggctgctgaagccaggcgtaaaaaccactgggatgaacatccagcacccgacagagcaggcgaacaggccagcaacaggagttgtcacggataaaggcgtacctcagtcggacagctttgcgaagtacgccgcggctttttttaatatgtcccgttcgtcggtaacccgtttcagctctttctggagacggcggatctcggcctgagcatctgactgttctttattagtggaagaatccggaccgtacttctttatccaggcataaaggctgtgggtggtgatatcgagacgtgttgcaacgctggcaacagaataaccgcgatcaacaacctgtttgactgcttcagttttaaactcttcgggataacgcttaccgctcatgggcacctctctttaagccatcttaaatgactctgaggtgtctgttaaacccgtggcgattcactcgggctcattcccctcaggatcaattgcgcccatgccattggctcgttgtaatgagccataccacgctcgaggcgtaagttgtttatatcacgttcaatatcccggctaagtggaataccgtcaaacgcaaaacgcagttcgtaaagccagcgttgattatctgatgacagctgcagactaagaagcttatctagtgcggagtgtaagagccgattggctgcacaatcaggcatgtagtcatcataatcgacacaaaacttatggcgattcaccgcgttatgtcgcagctgtgcagaaagcatcagcttgcccttcataaaagccagattaccttgcttgctcacatagtcggagcgtaaaccctgtttaagcaattggctgacgctatgcaaaaactggttaataaaaatctcaagcaaaggcatacgctgagcctgaagagtggcttgctgggtttgaatatgtcggaacccaggcagatggcttagcatcgtcagcaatgtttgacgtgcattagccgctgtgaggtttttaccaaccttgggcagtatctcaagctggaaaccgtgaggtgttgaaagcatccctgcgtagttttgaacctgaagcaatttgaagcctgagcgagaggtgagtttgaggaactggctcccttgattacttgccaggctaagcgcttctaaataattaaagacctgtggaggcaccggttttgcgccaactgaagccgcttttccactccccaagaggtcatattcaaaaacggagataacttcacccatgatttactgcctgctcatcaaggggagtctgttggggctgataaattgaacgataagcctgtggaatattccagatctcttgatcgaaatctttgagctcataagctgttgattgctgatcatggcgtcgtaaaccatggttgttaccaaaaagcgtatcgagatcgtcggttttctcaatcacgaattgcaggttgtcgtcttgcttttgattgtctgccagcaccaaccggatcttgttccagtcatcgaaaaagtattcctgtaaaagcggaatgatctttttctggaatgcgatcttcaattgtttaaacgcagcttcttcatcaccggcatcgagtgcattttttaccggcataaagaacgcatgccccagcgtatgttcacgatcgtaaagagcctcgatgcggctattgagtttctctaacaacgactcgagctctatgcctttcaccttagcttcactcagtaaagagagatcaggcatcatttcgacaaagtcaaagcgacggcgcaaagccgtgtccatcagagctaaagaacggtccgctgtattcatggctccgatgatatcgacattgccgggtacgctgaagtgatcaccgctataagccagttgcaggctcatcgcattgggcatgcctgcacgcttgtctacttcaatgagtgagattagttcaccaaagatcttggatatgttaccgcgattgatctcatcaatgaaaatggcgtagcgatgtcctggatcggcattcgcacgttggcaaaggcgcataaagatacccggctcaatgggataagagatattgccactctcgtcagagcgagcgcgtataccttcaataaattcttcatagccgtaagattggtggaacgtaaccaccgcaaaacgctggatggcttcggcagatttagggccacgtttaagttcggcgtagagctctaccaaatcctccacttgctcgagctgtgaatcaactagaaaccattcgctgttatctgttttgttaaatacggcaggctcacgccgattcttataatcaacggttaacgactcgggaactgtataggattgcaaagctgcccaggcagtattcgatagattgccattacgaccgtttaataatgccttacgttgaaaccacatatgttcaataatttggcgaactttcgctcgtttcccaagatcgagcagcaccagcgttataacctgcatccagttcaacgattcaaggcgagaatccagccaggcatcacgatcagcgggaacagcatgagaagtgtactctttcattttttgctgcaacctgaaggtcttgccagtgccaggggggccaaagaagatcacgttagttggtgaatgtaggatgatcttgttctcgatgggctcactgcgggttatggatgtagtgctagctactttctcctgcttttgttcattatcgcgttcacggagcaattcatagagatgccagatggccatattcacataataaggatctgtatcaggagattgggcgtgtatggcttgtttcaattcatagtttttctgtaaccaatttccggtcagtaccaaaccgagatggaagtgctgatttaagaattctgctgctttattaaaagcattctcatccacagtactggtgtagttttctggcgagaacgcggcaaagacgcgatttctcaaactccaatacatacgcttgagaagtccgttttctttagcttgttgaagtgcattgccaacatattggtaagtttcttcatccggctgttgccgaattcgttcagttagttctctaagcagtggcaggctttgctgatattctgctaaggatggaacgccctggcgaatacttgcaatgccgttgtcacgctcataccaaagctgtttgaccagaccatctgttgcaggctcagcaaaagttgaggtttgctgtagcaaagtcgtaaatgcacggtatcgctgataccatctggaagctgtgtaatttttatctttcgccagggcatcaatcaattcactaatcgttagcctacctgcttcgacactatctacaagagtcatcgtgacttttcctctgttgtgacattacttattttttaattaatatgaggtattctaactatattgagttaatcgttgtgacaagtgcctgttatatatacaactatctgttaactcagctctaatttaaatacaatgtaaggttgtagggtgaatgctgttatcaacctcaccccctaaaaacctctttccgatgccactctacaaacccctcaaaagggtaatttttacgcacctgtggtaacgcaatagttttcccgtcaaaatcccagaataatctctcaacgatccctccgccgttaaccgcatccgagaccagtacccgcatattttcgtccaggccaatcgatcctttatcaaaggctttatggtgaattgcgcaaagcgccaggccattaggaatttcacaaggaccgccgtgctgtttccattttatatgcgccgcttccagcgcgacggtggtgtcgtcgtggcgcatattaaagccacatatcgcgcactggtagttataagcgcgtaatacatttttgcgaaataacgggtcgcgctgtttacggatttgctggagatcaaaacccagctcgtcagcaatttcttcctgaatactctcggtgaagtgctcttcgagtatctgttgcgccagagtattgatgagttttttattgccggttaccagggcgtagtgctgttcatcgaaaccgcctgcaacgtggtattcgttcagttccttcactggcggttgtcggctgctccctgctgttgagcaaagctcggcattgtgtaattgccagaatccgtcgccttgtaatcgccagaacggcatatcaggtcggtactgtgaacgctgtggcccaaaacgttccagtaaactgtgcagaggttcgtagatttccgatccataatcgaaaaggcgtggatgtccattcaggtatcccgctaatacgtatagcaataacaatggtttatgcggtgcgcgctgttcacccttatgccagatttttatattggcaattgcctgctgtagcgatttactggaagccattgatatccctggcagtgaaataattgcgatcatgctcgcaaattttcggctgttcaagcctgcaagtgaagatatattactttgatctcatttgtttttttgctgcctgtgtaccctaattgccatgcgatgctgcaccgacgcaaaccaccgtttacgccggaggagttaaaagcgttgatggatgcgaataaatcaaattaatgaacgctcacttttcgcgccaaaactgcaaaattgcttctacaaacctgtcagaaataatcccccgacgggctgccgtgttgaaatgactgcttcgcagtgccgtcgtccagttctccggtgaccggtacgctgaaccgtaatatcccgtgcttaaatcgtccggatcttcatcaggcgcgttcgtcagtcctctttcaccttgttgctggaagtagacgaaaataatattggctaaaacattattttgataattgccataaataacttcatacgcatgagggaaattttctttccagtaccaggtggtatcgccgcaaaaccacggtgcgtcagtaatattattaagctgagaatggtattgttttagatccctacgaaaggcttcaaccatatgattaaagtgttgagggtgtgacgcgtagtcactggtcattaagtcaaattcgccttgcatccagcatacgccgaggaatttgttctgcggattttttgccagtgcggctcgcgttctgctgactaaatcctggtacagcggagtatccgttccccaacgacaagcatcatggctggctccgtgccgttctgaatatgtcccttcgctgcccgcggtaaaagccgatccgccacggcaacatggaacgatgagaacccctgcattatcaggaataaagggtagtaatttccgtgcaatatgcagtgcctggccaacggtgccgtactgtgtttgatgattcgttgccagaggatggtgataaccctgcatatcctgaacatcgtgtgggcagtgagtcagtggaataatgtcgttaaagtgacatgacgggcctccgggatgcgtatgcgcaaatctcgctaattgtttaattctgggatgaggcgcatcttccctgtccggtaatggcagtccttcgccatacgccatggcattagactgaccagcaacggtaagaacatagtaataatcgggcgatattattgcgttcatataaatttcgcgtaattgaaatgacaaattgatagcagggcccctttaccggggccctgaagcgttaattttgtactgtgactttattatccttcacagagatcaaaactgaatccgtcaccgctttgccgcctgcagtttcaccgccaataatcaatagactattattccagggcaatgatactccgtaggcccgaccttgcgataattcacccgatttatcccatttcccgttatgccaaagatgaatatcagtgctatatgatttttttaggccttcatgcgcatagttcttaccgttctggtaattttctcgtgaacctttgaatccggcccctccggcaaatataagagaatcattgcttatccccgcaaaaccgccagcgacgccatctggtgatgagacgggagcaagcttattccattttaaattattaccggtgaaatcaagttcaaatacggcatccgttcgcaatcctggtttggcttcgccattaataagccaggttttatcacctttattcacaaccgccgcaccagccgttccgtaccagggagattcgccagcgtaactccattgctgtgttgagggatcaaaagacaacagaaacttattgaagaaataatcttctgcttttttgtcaaaataatgggcattgatcttgtctatagttgctgaatcttttccagcctcgttgagatcttcaaaatagccattgaagatattctggttaacaccgccagtaacataagccttgccgttgtgtacaaaagtcacatgacccgccatgcccatcggtgcatgcgacatcaatttaacccaactattggttttggggttgtatttgtgtacgtcattaaatacctgagtcaagcccttgctatttttgccaatgccgccaaacacatacagattgccatcaataaatgccgaggttgcttgatctcttggtccaccagggaatgcagctaacgctgtccattttttatctttggcctgtgtatccagcttgtaccatgccgtacctgcgctacctaaaccaatgtagacagtgtcgttatcaattgctccggtaccacttttaaatggcacaggagtttcaggtaatacagacgcgtttgcggcaaatgaagccatcatgatagcaagcgccgttattgttttattcattgtgactgtctcctgtctactacagtttaaatgacacaccaatgcgataactgttttccgataaattatctctgccgttgtaaacaccctgacggtccaggtagtcatattctatgtatggcgtaatatcgggcgtcatatggtattgtagaacaaatgcattttccgtcgcccatttcttatggtttgcatagcgataatcgttctgtttgctgtatagcgtcgtttgccatgcgaaggtgaaatcactattaatatggtaagtgacatatccatcccaacgatgaacgttatcacgagacatatcaccggataagtcttgttgtcggtaagctttccagtcgtaacgatagcgaatgccaaaattaagatcttttgtcgcgtcccaggacagttttacgtagggtccgtagcgtgtgccgttgctgctaaaatgcgttaacattcccgggcgcaccgtccattgatcatcaagtttaatcgcgtaattaacttcaacctgaacatcattgagtgcggcattttcctttttattatcatgaatggtattccaggtattactttccatgcttgcccaccatccattttgccatccctcactgactttgagtcgagtctcataggcgtggcttccactacgatatccaccacgtacgtccagtgtcgcagcctgagaaattaatggggacgaaaagcacagtaataatacgccagaaagtattttagcctttttcataaatttcactcatttgtaggatacagaaagcaatacaaagcccgcataaacaattagcatttatgttgtgtaatatttttttgccaggcttatagtgtctttggcaaccggtagctgtattttatatttttttgtataatgtctcctgtgaaaaatctcttttcacattatttaaataaacagagatccagattaaatacctgagtataaaatctcttctgatgtttaattgatttgaatgttcgtaagctatatcacttactcaatccattttacccagagtcataaaatagaatgtctgttgatctcattttcatattcctttcagactgaagtgcgttttcatcacccgatgagaaagaactgaagtgatgtttgccatagattgcgagatgccctgtctcattgactatcttggtgcacctttatacctgttataccagatcaaaaatcacgcaatccatacaacaaaaccagatttgcaattcgtgtcacaaaatatgtcgatatttttctaagaagaagatgccatgtgaagccagacgaacacttgcggaggccttcacaaaccaaagattgttgtttaattatctgttttataagtaatttatttaaagtataaacaaggaaagatttgcaagctaactcagtgagcgtggtgaaaatcagtgtttacccgccatcaggctgagcataattctcatcatgaaatatgtttcctggtttgtggcttgtaactggtcacttctgaagtcgatctggagaggcttgttgatgttggtgttttcaggatgatgtttcacttagtttgtttgccgtatcgcccggcgaatggctgtgattgaggaaggtttaagtcgtagtgaccaaagctatatttaccaacgaatgtagatgaaaaaatcatctcctgcgttccccatatctccaggataaaaaggaatgtaacaatctcatggcgtaagctgacgaatcagccaggaataatcgctagggacctaagaattagcatgataatagccactaagaaattactgcgctccatgaaatagccattttgtggcaaatggagttgactaataatgtcatatgtgagacggctagttgaacgaatattaaattttgctgaattttttatgttgattttacttgttacagaacatatcacatgatatatagataagattagttgcattaatgatgagggttattattagattcgtatccgattgataaatatataaaggtacatagcatgcaagagcatggcgtttgtatggcaacgttattataattaactgttgctactccatttaagttcactcagaagaactggtccacttacgttagttattaagcaaacgttcgcttttataaacataatcaggataaaaatgttggattattgctaacccagcacagctagtgcgcgtctgtaattataagggaaaaacgatgaagaataaggctgataacaaaaaaaggaacttcctgacccatagtgaaatcgaatcactccttaaagcagccaataccgggcctcatgcagcacgtaattattgtctgactttgctttgttttattcatggtttccgggcgagtgaaatttgtcgattgaggatttcggatattgatcttaaggcaaagtgtatatatatccatcgattaaaaaaaggcttttcaacaacgcatccgctattgaacaaagaagttcaggctttaaaaaactggttgagtatccgtacttcgtacccgcatgctgagagcgagtgggtatttttatctcgtaagggaaatccgctttctcggcaacagttttaccatattatctcgacttccggtggtaatgccgggttgtcactggagattcatccgcacatgttacgccattcgtgtggttttgctttggcgaatatgggaatagatacgcgacttatccaggattatcttgggcatcgcaatattcgtcatactgtctggtataccgccagcaatgcagggcgtttttacggcatctgggatagagccagaggacgacagcgtcacgctgttttatagagatagttgagataccagggatggtgttaaaaactacattattcttacgatatatcaaaaatgattaaccatttattaattgatgttattgtaagtgtgattattaattttcataataaacattaagttaaccatatccatacaaaatacaatggtttatgttcttcaaaataaataaacaaaatcattcataaatttacacatcacttaaattctcctgtttccgcacttttttctttattttttaagcaactggaagttaatccactgcaatctattgttatattgaatcaaatcaatgaaaatagatgttgtcacatcagtgatattttatttttgtatgatatttaatgtaattgactgatagccacatcactccgtgtgtggttatctttttatctattgggctaattttgaccgattgaggtttcctataggtattcattcaaatatatctcagttaggagtactactattgtgagtaaacgtcgttatcttaccggtaaagaagttcaggccatgatgcaggcggtttgttacggggcaacgggagccagagattattgtcttattctgttggcatatcggcatgggatgcgtattagtgaactgcttgatctgcattatcaggaccttgaccttaatgaaggtagaataaatattcgccgactgaagaacggattttctaccgttcacccgttacgttttgatgagcgtgaagccgtggaacgatggacccaggaacgtgctaactggaaaggcgctgaccggactgacgctatatttatttctcgccgcgggagtcggctttctcgccagcaggcctatcgcattattcgcgatgccggtattgaagctggaaccgtaacgcagactcatcctcatatgttaaggcatgcttgcggttatgaactggcggagcgtggtgccgatacccgtttaattcaggattatctcgggcatcgaaatattcgccatactgtgcgttataccgccagtaatgctgctcgttttgccggattatgggaaagaaataatctcataaacgaaaaattaaaaagagaagaagtttaatttaacttattgataataaagttaaaaagcaaataaatacaagacaattggggccaaactgtccatatcataaataagttacgtattttttctcaagcataaaaatattaaaaaacaacaaaaagcatctaactgtttgatatgtaaattatttctcttgtaaattaatttcacatcacctccgctatatgtaaagctaacgtttctgtggctcgacgcatcttcctcattcttctctccaaaaaccacctcatgcaatataaaaatctataaataaagataacaatagaatattaagccaacaaataaactgaaaaagtttgtccgcgatgctttcctctatgagtcaaaatggccccaaatgtttcatcttttgggggaaaactgtgcagtgttggcagtcaaactcgttgacaaaacaaagtgtacagaacgactgcccatgtcgatttagaaatagtttttttaaaggaaagcagtatgaaaattaaaactctggcaattgttgttctgtcggctctgtccctgagttctacagcggctctggctgaaactacacccacgacggtaaatggtgggaccgttcactttaaaggggaagttgttaacgccgcttgcgcagttgatgcaggctctgttgatcaaaccgttcagttgggccaggttcgtaccgctagtctgaagcagactggagcaaccagctctgctgtcggttttaacattcagctgaatgattgcgataccagtgttgccacaaaagccgctgttgccttcttggggactgcgattgacagtgctcatcctaaagtactggctctgcagagttcagctgcgggtagcgcaacaaacgttggtgtgcagatcctggacagaacgggtgctgcgctggcgctggacggtgcgacatttagttcagaaacaaccctgaataacggaaccaacaccattccgttccaggcgcgttattttgcaaccggtgccgcaaccccgggtgctgctaatgcggatgcgaccttcaaggttcagtatcaataacctacccaggttcagggacgtcattacgggcagggatgcccacccttgtgcgataaaaataacgatgaaaaggaagagattatttctattagcgtcgttgctgccaatgtttgctctggccggaaataaatggaataccacgctgcccggcggaaatatgcaatttcagggcgtcattattgcggaaacttgccggattgaagccggtgataaacaaatgacggtcaatatggggcaaatcagcagtaaccggtttcatgcggtaggggaagatagcgcaccggtgccttttgttattcatttacgggaatgtagcacggtggtgagtgaacgtgtgggtgtggcgtttcacggtgtcgcggatggtaaaaatccggatgtgctttccgtgggagaggggccagggatagccaccaatattggcgtagcgttgtttgatgatgaaggaaacctcgtaccgattaatcgtcctccagcaaactggaaacggctttactcaggctctacttcgctacatttcatcgccaaatatcgtgctaccgggcgtcgggttactggcggcatcgccaatgcccaggcctggttctctttaacctatcagtaattgttcagcagataatgtgataacaggaacaggacagtgagtaataaaaacgtcaatgtaaggaaatcgcaggaaataacattctgcttgctggcaggtatcctgatgttcatggcaatgatggttgccggacgcgctgaagcgggagtggccttaggtgcgactcgcgtaatttatccggcagggcaaaaacaagtgcaacttgccgtgacaaataatgatgaaaatagtacctatttaattcaatcatgggtggaaaatgccgatggtgtaaaggatggtcgttttatcgtgacgcctcctctgtttgcgatgaagggaaaaaaagagaataccttgcgtattcttgatgcaacaaataaccaattgccacaggaccgggaaagtttattctggatgaacgttaaagcgattccgtcaatggataaatcaaaattgactgagaatacgctacagctcgcaattatcagccgcattaaactgtactatcgtccggctaaattagcgttgccacccgatcaggccgcagaaaaattaagatttcgtcgtagcgcgaattctctgacgctgattaacccgacaccctattacctgacggtaacagagttgaatgccggagcccgggttcttgaaaatgccttggtgcctccaatgggcgaaagcacggttaaattgccttctgatgcgggaagcaatattacttaccgaacaataaatgattatggcgcacttacccccaaaatgacgggcgtaatggaataacgcagggggaatttttcgcctgaataaaaagaattgactgccgggtgattttaaaccggaggaataatgtcatatctgaatttaagactttaccagcgaaacacacaatgcttgcatattcgtaagcatcgtttggctggtttttttgtccggctctttgttgcctgtgcttttgccgcacaggcacctttgtcatctgccgaactctattttaacccgcgttttttagcggatgatccccaggctgtggctgatttatcgcgttttgaaaatgggcaagaattaccgccagggacgtatcgtgtcgatatctatttgaataatggttatatggcaacgcgtgatgtcacatttaatacgggcgacagtgaacaagggattgttccctgcctgacacgcgcgcaacttgccagtatggggctgaatacggcttctgtctccggtatgaatctgctggcggatgatgcctgcgtgccattaacctcaatgatccatgacgctactgcgcatttagatgttggtcagcagcgactcaacctgacgatccctcaggcatttatgagtaatcgcgcgcgtggttatattcctcctgagttatgggatcccggtattaatgccggattgctcaattataatttcagcggaaatagtgtacagaatcggattgggggtaacagccattatgcatatttaaacctacagagtgggttaaatattggtgcgtggcgtttacgcgacaataccacctggagttataaccgtagcgacagatcatcaggtagcaaaaataaatggcagcatatcaatacctggcttgagcgagacataataccgttacgttcccggctgacgctgggtgatggttatactcagggcgatattttcgatggtattaactttcgcggcgcacaattggcctcagatgacaatatgttacccgatagccaaagaggatttgccccggtgatccacggtattgctcgtggtactgcacaggtcactattaaacaaaatgggtatgacatttataatagtacggtgccaccggggccttttaccatcaacgatatctatgccgcaggtaatagtggtgacttgcaggtaacgatcaaagaggctgacggcagcacgcagatttttaccgtaccctattcgtcagtcccgcttttgcaacgtgaagggcatactcgttattccattacggcaggagaataccgtagtggaaatgcgcagcaggaaaaaccccgctttttccagagtacattactccacggccttccggctggctggacaatatatggtggaacgcaactggcggatcgttatcgtgcttttaatttcggtatcgggaaaaacatgggggcactgggcgctctgtctgtggatatgacgcaggctaattccacacttcccgatgacagtcagcatgacggacaatcggtgcgttttctctataacaaatcgctcaatgagtcaggcacgaatattcagttagtgggttaccgttattcgaccagcggatattttaatttcgctgatacaacatacagtcgaatgaatggctacaacatcgaaacacaggacggagttattcaggttaagccgaaattcaccgactattacaacctcgcttataacaaacgcgggaaattacagctcaccgttactcagcaactcgggcgcacatcaacactgtatttgagtggtagccatcaaacttattggggaacgagtaatgtcgatgagcaattccaggctggtttaaatactgcattcgaagatatcaactggacgctcagctatagcctgacgaaaaacgcctggcaaaaaggacgggatcagatgttagcgcttaacgtcaatattcctttcagccactggctgcgttctgacagtaaatctcagtggcgacatgccagtgccagctacagcatgtcacacgatctcaacggtcggatgaccaatctggctggtgtatacggtacgttgctggaagacaacaacctcagctatagcgtgcaaaccggctatgccgggggaggcgatggaaatagcggaagtacaggctacgccacgctgaattatcgcggtggttacggcaatgccaatatcggttacagccatagcgatgatattaagcagctctattacggagtcagcggtggggtattggctcatgccaatggcgtaacgctggggcagccgttaaacgaaacagtggtgcttgttaaagcgcctggcgcaaaagatgcaaaagtcgaaaaccagacgggggtgcgtaccgactggcgtggttatgccgtgctgccttatgccactgaatatcgggaaaatagagtggcgctggataccaataccctggctgataacgtcgatttagataacgcggttgctaacgttgttcccactcgtggggcgatcgtgcgagcagagtttaaagcgcgcgttgggataaaactgctcatgacgctaacccacaataataagccgctgccgtttggggcgatggtgacatcagagagtagccagagtagcggcattgttgcggataatggtcaggtttacctcagcggaatgcctctagcgggaaaagttcaggtgaaatggggagaagaggaaaatgctcactgtgtcgccaattatcaactgccaccagagaggcagcagcagttattaacccagctatcagctgaatgtcgttaagggggcgtgatgagaaacaaacctttttatcttctgtgcgcttttttgtggctggcggtgagtcacgctttggctgcggatagcacgattactatccgcggctatgtcagggataacggctgtagtgtggccgctgaatcaaccaattttactgttgatctgatggaaaacgcggcgaagcaatttaacaacattggcgcgacgactcctgttgttccatttcgtattttgctgtcaccctgtggtaatgccgtttctgccgtaaaagttgggtttaccggcgttgcagatagccacaatgccaatctgcttgcacttgaaaatacggtgtcagcggcttcgggactgggaatacagcttctgaatgagcagcaaaatcaaataccccttaatgctccatcgtccgcgctttcgtggacgaccctgacgccgggtaaaccaaatacgctgaatttttacgcccggctaatggcgacacaggtgcctgtcactgcagggcatatcaatgccacggctaccttcactcttgaatatcagtaactggagatgctcatgaaatggtgcaaacgtgggtatgtattggcggcaatattggcgctcgcaagtgcgacgatacaggcagccgatgtcaccatcacggtgaacggtaaggtcgtcgccaaaccgtgcacagtttccaccaccaatgccacggttgatctcggcgatctttattctttcagtctgatgtctgccggggcggcatcggcctggcatgatgttgcgcttgagttgactaattgtccggtgggaacgtcgagggtcactgccagcttcagcggggcagccgacagtaccggatattataaaaaccaggggaccgcgcaaaacatccagttagagctacaggatgacagtggcaacacattgaatactggcgcaaccaaaacagttcaggtggatgattcctcacaatcagcgcacttcccgttacaggtcagagcattgacagtaaatggcggagccactcagggaaccattcaggcagtgattagcatcacctatacctacagctgaacccgaagagatgattgtaatgaaacgagttattaccctgtttgctgtactgctgatgggctggtcggtaaatgcctggtcattcgcctgtaaaaccgccaatggtacagctatccctattggcggtggcagcgctaatgtttatgtaaaccttgcgcctgccgtgaatgtggggcaaaacctggtcgtagatctttcgacgcaaatcttttgccataacgattatccggaaaccattacagactatgtcacactgcaacgaggctcggcttatggcggcgtgttatctaatttttccgggaccgtaaaatatagtggcagtagctatccatttccgaccaccagcgaaacgccgcgcgttgtttataattcgagaacggataagccgtggccggtggcgctttatttgacgcctgtgagcagtgcgggcggggtggcgattaaagctggctcattaattgccgtgcttattttgcgacagaccaacaactataacagcgatgatttccagtttgtgtggaatatttacgccaataatgatgtggtggtgcctactggcggctgcgatgtttctgctcgtgatgtcaccgttactctgccggactaccctggttcagtgccaattcctcttaccgtttattgtgcgaaaagccaaaacctggggtattacctctccggcacaaccgcagatgcgggcaactcgattttcaccaataccgcgtcgttttcacctgcacagggcgtcggcgtacagttgacgcgcaacggtacgattattccagcgaataacacggtatcgttaggagcagtagggacttcggcggtaagtctgggattaacggcaaattacgcacgtaccggagggcaggtgactgcagggaatgtgcaatcgattattggcgtgacttttgtttatcaataaagaaatcacagggcattgctaatgcaggtacgcaatattacctgaagctaaaaacctgcacgttagccctttgtaggccagataagacgcgttagcgtcgcatctggcataaacaaagcgcactttgctggtcttttcccctcaccctaaccctctccccagaggggcgagaggactgtctgggcacatttttagactttgtcatcagtcagagcctgccattggcaggctctggtgtccttttacgctaccatgctaataatcagcacaataatcagcccaaccacggagttgaccagctccagcagaccccaggttttcaacgtgtcttttactgacaggtcaaagtaacctttgaacaaccagaaagatgcatcgttaatgtgggtgagggtgttggaacccgcagccgtcgccagtaccagcagcgccggattcacgccaaccagctgaccagttgctggatcaaggattgcagcacttataatcccggcggcggtcatcgccgaaacgacaccctgacccgtcgccagacgaattagcacagtgatcagccatgccatgatgtagggcgagatattgccgtgggacatcaacatgccgatggtgtcgccaatgccggtgtcgatgatagtctgcttcagcacgccacccgcaccgatgatcagaatcaccattgcaatactcttcaccgcgctttcaaaagcgttcatcacccactgcatgtcatgaccacgtgcggtgccaaagagtacgaatgcaaccaccatcgcaataaacattgcaatcggcgaggaaccgataaagttaaccacttcccaggcaggggtatcttttaccagccagatattggcgatggtggtagagatcataatgatcgccgggatcagcggcaccagaatcgaaacgccgaaagagggcagattattcatatctaccggttgatctgctttcaggaatgatggcgttgggcgctcaagattgccgaggaacttcggcaggatcagacctgcgcagattacacttgggatcgtcaccagtacgccatagatataaaccatccccatatccgcgccataagcattcaccagcgccaccggacccggctgcggtgggaacagtgaatgtgcggtagtggcagctgctactgccgggatcgccagtttcaggaacggaattttagcttcggcggcaataacaataaccagcggcgctaacatgataaaggccacttcatagaacatcgccagaccaaaaatcaagccgatgataatcaccgacagctgtacatagcgcagaccgagacgcgccagcagcgtatgcgctatctggtgagccgcgccggagtcgaccatcaatttaccgatgaccgcaccgaacaccacgatgatagccagttcccccagcgtgttgccgaagcccgctttcatggtgtgcagcagcgacatcaaatccatgcccgccagcatcccgacggacagcgccgccaccaacaaagccaccattgaattgattttgaacttcaaattcagtaccagcatcagaccaatgccgaataccacccagagaatgttaagcacatgcataacgttttaccttacctggttgaaccgttgttattttgggcgacatgttatgtaaattggtcaaccattgttgcgatgaatgtcacatcctctgatcaataaccatcgattaccctttgctgcaatttgcagcaacaaccatgagagtgaaattcttgtgatgtggttaaccaatttcagaattcgggttgacatgtcttaccaaaaggtagaacttatacgccatctcatccgatgcaacgccacggctgcggtctggttgttcatccggatacctaaacaactctagggttccgcgtctctttgctgtggaacccactatgtgaaagaggaaaaatcatggaacagacctggcgctggtacggcccaaacgatccggtttctttagctgatgtccgtcaggcgggcgcaactggcgtggttaccgcgctgcaccatatcccgaacggcgaagtatggtccgttgaagagatcctcaaacgcaaggcgatcgttgaagacgcaggcctggtatggtctgtcgtagaaagcgtgccaattcacgaagatatcaaaacccacactggcaactatgagcagtggatcgctaactatcagcagactctgcgcaacctggcgcagtgcggcattcgcaccgtgtgctacaacttcatgccggtgctcgactggacccgtactgacctcgaatacgtgctgccagacggctccaaagctctgcgcttcgaccagatcgaattcgctgcattcgaaatgcatatcctgaaacgtccaggcgcggaagcggattacaccgaagaagaaattgctcaggccgctgaacgcttcgccactatgagcgacgaagacaaagcgcgtctgacgcgtaacatcattgccggtctgccgggcgcggaagaagggtataccctcgaccagttccgtaagcacctggagctgtacaaagatatcgataaagcgaagctgcgcgaaaactttgccgtcttcctgaaagcgattattccagttgctgaagaagttggcgtgcgtatggcggttcacccggacgatccgccgcgcccgatcctcggcctgccgcgcattgtttccaccattgaagatatgcagtggatggttgataccgtaaacagcatggcgaacggtttcaccatgtgcaccggttcctacggcgtgcgtgctgacaacgatctggttgatatgatcaagcagttcggtccgcgtatttacttcacccatctgcgctccaccatgcgtgaagataacccgaaaaccttccacgaagcggcgcacctgaacggtgacgttgatatgtacgaagtggtgaaagcgattgttgaagaagaacaccgtcgtaaagcggaaggcaaagaagacctgatcccgatgcgtccggaccacggtcatcagatgctggacgacctgaagaagaaaaccaacccaggttactccgcaattggtcgtctgaaaggcctggccgaagttcgcggtgtcgaactggcgatccagcgcgctttctttagccgttaatatccaccggcatggctgcgcgccgtgccggttccttcttccttgccgtcactctctgaagacggattctggagtttacgatgactactattgttgacagcaatctgccggttgcccgcccgtcatgggatcattctcgtctggaatcacgcattgtgcatctcggttgcggggcgtttcaccgcgcgcaccaggcgctgtatacccatcatctgctggaaagcaccgacagcgactggggcatctgcgaagttaacctgatgccaggcaacgaccgcgtgctgatcgaaaacctgaaaaaacagcaactgctgtacaccgtagcggaaaaaggcgcagaaagcaccgagctgaaaattatcggttcgatgaaagaagcgctgcacccggaaatcgacggctgcgaaggtattctcaacgcgatggcgcgtccgcaaacggcgattgtctctctgacggtcacggaaaaaggctactgcgctgatgcggcaagcggtcaactggatctcaataacccgctgatcaagcacgatctggaaaacccgactgcgccgaagtctgcgattggttacatcgtcgaagcgttgcgtctgcgtcgtgagaaagggttgaaagcgtttacggtgatgtcctgcgacaacgtgcgtgaaaacggtcatgtggcgaaggtcgcggttctggggctggctcaggcgcgtgacccgcagctggcggcatggattgaagagaacgtcaccttcccgtgcaccatggttgaccgcatcgttccggcggcgacgccagaaaccttacaggaaattgctgaccagctgggtgtttacgacccgtgcgccattgcctgcgaaccgttccgtcagtgggtgattgaagataacttcgttaatggtcgcccggactgggataaagtgggcgcacagttcgttgcagacgttgtgccgttcgaaatgatgaagctgcgtatgctgaacggcagccactctttcctggcatacctcggttacctcggcggctatgaaactattgccgacaccatgactaacccggattatcgcaaagcggccttctccttgatgatgcaggaacaagcgccaacgctgtctatgccggagggtacggacctgaaggcctatgcgacgctgctgatcgagcgtttcagcaacccgtctctgcgtcaccgtacctggcagattgcgatggacggcagccagaagttaccgcagcgtctgttggatccagtgcgtctgcacctgcaaaacggcggcagctggcgtcacctggcgctgggcgtggctggctggatgcgttacacccagggcgtggatgagcagggtaatgccattgacgtggtcgacccgatgctggccgagttccagaagattaacgcgcagtatcagggcgcagaccgcgtgaaagcgctgctgggcctgagcggtatttttgccgatgatctgccgcagaatgccgactttgttggcgcggtgacggcggcatatcagcagctgtgcgaacgcggtgcgcgcgagtgtgtggctgcgctgtaactaactgattaccctacagacttactggtcaatcaaactgatatttggttgaccagttttcgtttttttgcccacctgtacgtgccaacttccagtgctaatggtatagtttgagattaacgggggccgtaaaattgcccgttgtaggccggataaggcgttcacgccgcatccggcaaaaatttgattaaccgcacctaacggacacagcaccatgaaatctgccacctctgcgcaaagaccttaccaggaagtcggggcgatgatccgcgatctgatcataaagacgccgtacaatcctggcgaacggctgccgccggagcgtgaaattgcagaaatgcttgatgtcacgcggacggtggtacgtgaagcgctgatcatgctggagatcaaagggctggtggaagtgcgccggggtgccggtatctatgttcttgatagctcaggcagccacaacacagacagtccggatgccaacgtctgcaatgatgcgggtccttttgagctgttacaggcgcgtcagttactggaaagtaacatcgccgagtttgccgccctgcaggctacccgcgaagatatcgtcaaaatgcgtcaggcattgcaactggaagagcgtgaactggcttccagtgcgccgggcagcagcgaaagcggtgacatgcagttccatctcgctattgccgaagcaacgcataacagcatgctggtggagctgttccgtcagtcctggcagtggcgggaaaacaacccaatgtggatccagttgcacagccatctggatgacagcctgtatcgcaaagagtggttgggcgatcacaaacagatcctcgccgcgttaatcaaaaaagatgcccgagcggcgaagctggcaatgtggcagcatctggaaaacgttaagcaacgtctgctggaattctcgaacgttgacgatatttattttgacggctatctgtttgattcatggccgctggataaagtcgacgcctgacttattataataagcgcaagggtaaacgttccttgcgctttcttaaattaagaagtcgcaatgagtattactttgtaaattgcagggtattgtttaaatatctgtataacctgaatattagtactcattcttctcagtggctatttaccaatataattccattcaccattttttaattcaaacagttctggaagagatgacggttgcagagtcatgcgtttgagtggcgcatcttcatcaccggggataacgttatatcccatttttgcatggatctccgcggtaccgggataggcttctataccaattattgggtcatttcccattccaatattagcattaagtaatgcggcaagggcgaatccggaagaatttgctacccctgagacagttattatctgatcaatatagatatcaattcttggctgctcattggtccatctttttgcctgagaaactggaagggttgaaatatatcctatcgtggttccggcgtaacctggaacattgcaaccagggcctaatgttatttcatgaactgtatagtcctcaacaggatcgaaagggctcttcataaataaatttagccgtaaaccttctgctaattctgtagcagcatgcgcctttttacatataccaccatatatttcgtctaaagctgaggtgattttcaagtttcgatagagcatacgtcctgttgttgtaataccatcggattctctgcatgcttctgtcacataattaaatggccaggactctttactaatatcaagttttctaatttcgacaacgctttttccatcgtaattatggttattgccacgagcaagaggcagaagatagatattttccgtatccaggcgagctcgttcatatttacgtgttaactcattgtcgacttttgggtgatgaaggaagtgattatctgtaataatttgactctgaagggcattgcttaatggcatagacataatagttaccttttaggagtatttcactgatgtttagaaaaatagataaatttttctgtagtaaaaagagaagtaaacaaatgacatgcatgtttctgttgtagtgatatcaactctacacggtgatattaaagggtaggaaacactctaaagtatcaaaaaacgctcatttgaaattattttcatgcaattaaaaagcatatcttattactaattggaatttgatgttgctatattgatgtctatattaataatgcctgtgaatggtatttttgatgtatttgatatgttatcaatttatattttttacaaactaattgtttcaaataatacatggctgattatgcggaaataaataatttcccaccggaattaagtagcagcggtgacaagtattttcatctacgtaactattcggaatattcagaatatactagcggtttttttttgagtttgatgatttttatcaaatcatgacttttttcctgaaaagtcagtagatattcataggcaagtaaggttttatactttgctgacaggattcaggcctgtctcagactgacatggatgtaatgaacaaaagggaatggctatggaaaatgagcatcaatacagtggtgcccggtgttcagggcaagccgcatatgttgctaaacgtcaggagtgcgcaaaatgatgcgccaatcacttcaggctgttttacctgaaatttcaggcaataaaacgtcattgctgcgtaaatcggtatgcagcgatatcctcactctttttaattctcctcattcggcattaccgtcattacttgtttcaggcatgccagagtggcaagtgcataaccagagcgacaaacatctccagagctggtattgccgtcagctgcgttctgcactgttatttcatgagccacggattgcggcgttgcaggttaattttaaagaagcgtactgccacactctggcgatcagccttgagataatgctgtaccacgacggtgaaccgctaacgtttgatctggtctgggataatggcggttggtgtagtgcgatgctggagaatgtcagctaagcacaatctccagctcgcgcagttcacgccagaagcgttcggcaactggattcatgcgggtattcattcggtatgcataggcctgaatcgggatcaccagttcgtcccgattcagtacaacgagcttcccgctgcgaatttcttgttggatggcgtactccggcagccaggcaatcccacagccgtcgagggcaacctgctttaaaagctcgctcatcgaagagacaaaaaaggtgctgaaacttaactcactgtggcgcgtcagggtgcgattaatcaatcgccccatgtaggagttgcggctgtaattcagtaacggaaagtgtggctgcgcgaggttaaaaagtgcttctccgtgttcgtcactggcgcagacagggaacaattgagattcaaataagcgaatgtggtcaaacggcgcttccagcaaatcttcgtcgtgaaaggaaaaaatacagtcactttgcccttcacgcagtttatcgaccgcttcatcgacatcaatagcttcaattgcccaggtaaagagcggcggcatctggctgataatggacggtaacagtccgagggaaagagagtgtgcagcggctatcttgatttttcgttgcgcgtaatcgctgccgccacgcagctctgccagattgctctctaactgttgcaacagatggcggatctgcgaatggaagatttttccttgttctgagagttgcagcggcgttacttggcggttaaacaattcaacaccaatcgcctgttccagcgcacggatgcggcggctgaatgccggttgcgagacgttgcgactgactgccgcctgggaaaaattgcggcatttttccagggtcagaaaatcataaagccatttggtttcaatattatgcaaaatcgcaccacagtcatccattacgttttactctgtcagccgcccttgcgggcattctacgtccattcgggcggctgacaaccgtttaagccgtttcaaacgttcctttcacgcaggctttgccgtctttgaccatcagtttgccgcgagcgtatacctgctcaatgcgcagttctggcgtcatgaccagcaagtcagcatcattgcctggcagaatttcgcctttcccggtcaggttaaggaaaccggctacgctactggtgagcgggcgcagggcatcgctgatactgaaatcatagtctttgaccagcacctgcacggtttccagcaacgtttcaaaaccggcaacaccgatatgggttaaattcccttcgtcatcgaagaacggctggctaccgttgccgtcggagctgagggtgacgcgtgccagcggaatacccgcctgaacggcgcgggcaataccttcggcaggggcgaccggttcgtcaatgctgctggtgatatcgatagtgccgcctttgcgcgcgaactccagcgcctgctcaaacaacggaacgttgcggttaacgtgggtcggcagcaacttgctgatcggcacatcgcagttttccagcaggtcatagacaggctgtaacgcctttttgctgtcgcccatgtggaacacggtgacgccaggtttaccgccgagcaaaccgccaacgcgggattccgccgccatattagccaggtgataaacgtccggtgcggcagaacggtgatcagagatggcgcatttcacgccaatcacacgatcgataatcgccacgtctttttccacggaacctgtaatggtgcgggaagggacatgataagcgccggtcagcatccaggcgctgatgccttcttcattgagcgcacgggtcttggcgagcagggattccgggtggcgagagatagagtcggtgcccagcagaccaaccactgacgtgacgcccgcttccgtcaggcgacttagcgccacttctggcgtgcgcgtcgtgggacctgcttcaccgccaccaccaatcaaatggacgtgttgatcaataaaaccaggacagaggatctgcccgctgagatcgacaaccgtgcagtccggtacaatgtcagaagggatattgctggcaacggcgataattttgccgttagcgacgaggacatcgcaaattccccgatcttccggcgcatacaaatgcgctccctgcagcagggtaaaaccggctgcggtataatcaatcatggtaactccttgttaaacaataagctgcataacccagatcgacagcaatgcgttaatcacgcagaccgtaatgatatgcgggtaatatttggcattcacttcggctgtccccaggcagcgaccgacattttgcaccgggttgcccattaaatacatcgcgggcagtaaaacggtgacatcgtgaccggttaatgcgccggcggtcgccagactggcggcaacaccgactgcgccgcccatactcattaatgcggctaaaaggacggttgccgcttcaccgggcaatccccacagcgccattacgggttcacagatatgccccacccagtcgagcaggccggtaattttcagcgcctgaatgatgacaaacgccatcaccacgtttggcagcaggttggtcgtggcgatagtaaagccacggcgcgcgccatcgataaacatatccatgacatttttgcggacctgagttgtcatgcttgcgctccttgcgttgggttgcgacgttcttcgaagttaagccagacgcgcaaaatgttggctccgacaaatttaaacaccaggatgacggctaaaggtacgattacggacgtgcccagaaaggcaaacaccgcgacgccggaagagaagtagttggtgatgatggcgctaccgctggtttgatatgcggcgaaaatcactttatcgcgttcggtaatttcaccttcctgcgccagctctttggtcataccggcggcggcatccgtgttttgcaggttagcgatcagcgccagcgagcagatccctggaatgcccaacaacggttttagcactggcgtcattaactgctgcgcggcgcgtaatccgccaagaccatcggtaattgaaataatccccagagagagaatgactgacggtgccagctccagcgcaaagagaaagccatctttagcccccgcgccacccgccccgcgaaatgaggtggtggctccgttcgcaccaggcagttgcccaaacgatccgttcagaacggaaaaatcaaaaacgcgccaccagctgtctgttccggaaaaaacaccggaaaaaaagattatggtgagaaaaaaagccagataccctttaatgcccactttttctgtcgccagctccccggctacagcatccccttgttgtgtcataacaatccccattgtttttttgtgtttgtgtgttgcttgagccaggaaaattcctggagcggaaaaaccttatcagccatgtgggtatggggaaaatgcaagtatgtttctggctatgcgttttttgcatagcggaaaaattacgctgtgtggaaaaggctctgcgcaggattgagttgcagaaaattcataaacccagtgacaatgacatcagtaaataaaaacagaaaatccagggacgaaaacgagatggcaaagtacaacgaaaaagagctggcggatacgagcaagtttttaagttttgtcctccgacacaaaccggaggcgattggtatcgtacttgaccgtgaaggatgggcggatatcgataagctcatactttgtgcccaaaaagcgggcaagcgattaacccgtacattgctggataccgtggtcgccaccagtgataaaaagcgttttagttattccagtgatggtaggtgcatccgcgcggttcaggggcattcgacttcgcaggtcgctatttcctttgccgaaaaaacaccgccacagtttctttaccacggtacggcaagccgtttccttgacgagataaaaaaacaggggctgattgcaggggagcgtcattacgtgcatctctctgctgatgaagcaacggcacgcaaagtgggagcaagacacggatcgccggttatcttaaccgtcaaagcacaggaaatggcgaaacgaggcatccctttctggcaagcggaaaacggagtctggctgacatcaacggttgcggtcgaatttcttgagtggtaagggaaacactcctcatgaagtgaccacttgcagcttaaataattgtactgtgctgataagcgcagcaataaacaacgccgccgcgccgcagagagtggcgccggcaagcgccgatgttccattgccgagcatactggtcagcgccgggccgaggatttgtccaatgccgtaaatgagcgtcacaaagcctaaaagattgagatttcccggaacgctcagttggcgggcgatagtcatcaccagagatgtcgtgcccataaaggtaccgccaaaaccgatactactaatgataagcaagagaggagagtcgctggcgagagtaagcagcacactgatagcctgcaccagcaaattcgccgtcaggcaaggcaaagccccccaacgttttgctgcccatagccagctaaagcagcctggcacaattgataagccgactaacgtccagagatgggcggttaacaatggtgagcctgcatctttcgccatgagcggcaggtaagtcgcgacgatgatataaccaaatcccgccaggccgtacagaatagccagtaaccaccagctcattatctgttgctccgtttttgccaatggcattggtgcgatggcgtgttttttcgagggcattaaaagcgtaagtgcaatcagcatcatgccagaaagcgccccggcgccttgccataacgtttgcgaggataaggcaaaatgcaggcctgccagaacatattcgttgcccagtgcaatgccaatgccaacgccagaaaacaaagctgccagcacaaaaggatggcgcgtgtgctgcataatcagcgtcgaaccaaaaatcagcataccggcgctggcgacacccgccaggaagcgaatcaataacaccagaataaatggcggcaaccatgccattgcgaggatcaacaacccgctcgccagggcagaaaccaacagaaatgggcgtaggcgcgacggctggtgaaatgcgccaaacgaaaatagcagactgccagccagataccccgcatagttgccgctggcaatccacgagagctggctaaatgaaaacgccccttccgccatcatgacgggcaacataggcgtataaaggaagcgacctaatcccatacctagggtcagaaccagcatcccgaaaagcgcggtgctgaaagaaaagcgttctacgggatgcgaggacgaaggcatgtttaaccttgtatgtcatttttgttgttaacaagttaataacaaaaaggtgaaatatgccagcctgttaatgcgatgatttaggggtaaagcgataaaaacgatttggttcgctaacgatataaatattaccagaggcatccatcgcaatcccttcggcctgtttgatgttatgcgacaaacctcgactacctttggttagtgatatttcaccgataacctcgccaaccagggttacttcctggagtgcgcgagattcatgagacagcaccagaagcgtatttttttgctggttaaattctgcgccggacacatcatctaaagtaaattgccgttgtagtgcctcgtctttgctgatgtgtaattcattgctacttaacagcccgttaactttgtagacctcaatcggatttttctctttaaaaaaccagaaagtgtgatcctggcgagaataagccaacccttcaaaaccgcaattggttggggagtcttgcagcgggatttttatttttttgaggatttttacttccgagtttgaggtcagtgaaatcacataaatggcgtaatcgcgctcatcgctaatgacaaactgattatcgccaatgtattcgatcgtctcgagatccttaacaaaatccagaggaattgtgcggataaaatcaccattggtggtcatttcaacaatggcggcaggtttgttgatagtgctaaaaagagtattgctttgtgccgaccaggtcagcgaagagatattattcgttatgcctgcaatttctttgccgtcaatggtggcgtggtaattctgaaatgatgctgcatgattgcttttacgggcgcaagattgcacgaagaaagtacacactgccacaatggcaaaaagaatcacaataacggagatgcgtttacttaacgaaatactttttgtcacggtaatccctttaaggcaaatcaataagatatcgagaagtatacgtagcgaccttaatgaatccttaacgcggagaaacccggtaatgtgcaatgcagcgccagacaccatcctgctgacaataaattgactcagtcagcccagggatcacccattgtatttcctcgccggggggacaggtcagccaaatgcataacccgcagccgccgcgtaaatcacggggaatatcgctgacgcgaaaagtcatgcccgctgcctgcaacgctttgcgggtttgtatgacgccgactgtggagtgaaataaaaataaaaactctttcatcggcgtgtcctcactcgttgaccaattaccgccgcgccaattgcgccagcaaattgcgcatcaggatgggtatttaccggcattcccagatgagattccagcatccgggcaaacgtctggcaatgactaacgccaccagtaaacagaatcggcgcttcacaggagagacgagcaatgaaattggcactcctccgcgccatcgcgttaatcactccggcgagaatcgcttctggcgcgacgcccgctgagcgcaggctgatcacttctgattcggcaaacactgtgcacatactcgtgatggcgtgcggcgtgacattttcggtaatgctgtcgagttgctcgacgctggtgccaagcgtgcgcgagatcacctccaggaaacgcccggtgcccgccgcgcatttgtcattcatcaggaaatcgcacaggttaccgtcatcatcaagctgaatcactttgctgtcctgaccaccgatgtcgattaccgcgcgcgttgctggcgcaagaaaccgtgcgcccagcccatgacaggagatttccgtcacttgtttatcggcaaaatccaccagttgccgtccatagccggtgagcgtcagaaacggcgttgtctctaacccttcgcgcagagtttcccaggcttcagtaattgctgttgccggacgaaagggtgttggaacgaggaaacggcgcgtaatcacgccgtctgccagtaagatccctttggtggcggtagaaccagaatcaatgccaatcgaatatgtcactgccactccttacagcatctcaataaaggccgcgacacgggtactgagctgcccgacatctgaggtggagtagtctgtttcaatagcgatataaggaatgttgtgctgctgacgcacatgacgtttaatcgccagcgattccaccgcgtaggtatggcacgcctgcaaaatcacatcaactacgccatcgacctgatattcttccaccatctggctgagcatttgcaggcgctgatcgttcggcgaaacacaggagcagccaatcgccagatatttatccgccagtgcgtcgtagacatcgcccgtttctgccacgcattgctcggtcgctttcgccccggtgcagttttcataaccgacaacccagccgccattctcttcaatcgcgcgcaccactttttctgctgcgccgccaatcgggcagccggtgattaaaatgcgtggacgcagggccagccgctggccttcttcccactgctgacgaacgcgggctgtcatcgcgtccagttcattgatcaacgcctctttatcgaaccggaaggttgcgccgtaaaccactttcagaatgtcgctgccgctaagcgccggaggatttaactgcccaagatgataaaaattggccagtgcgcgacgttcgcggtttttcagcgcaatggcatcgcgcagagcatcttcgctaatctcgtgcccaaaacgttcttctatcgttttttgcaagcgcagcatctcggctttccataacgcacgcgaggcatcgtccttaacgctgttcggcaactgcatcacatgaacgggcttaaactccgccatgtattcatacattttctttttgccgtcgcaggtggtttcaccgaccaccagatccgaaaagtagaagtaggggcatttatcggttttgccgaagccgtagctgcttttaatcagcgggcagaggttgcgcggcagatctttctccgcttcttcaatggtttcatcagaggtagaacagagcgaaaccacaaccgcaccggctgccatcgggatctcttgcggcataaaggtgcagtaagtgccaaccagcggaatgccgcgctccttgagatccatgacggtgagaaagcctttctggcgagcttcagagaactgatcgaaaatggcgggtagatcggtgataagtgacatgattttccttccccgtaccacgggagataatgaaaagaggccacattattaccattcttttagtgtggtttatttgatctctctcgcggttagccacttagtttttcatggatttctaaaaattgctgagggggaacaaggccgggagctgcgacaacaaatataaaattagcccaatacaaccgccaaccagcgtaccgttgacacggataaactgcagatctttgccgatatttaactcgatttgccgcgacatatctcgcgcatcccagctttttactgtatcgctgatgtggcgcgtcaggaatgcggaaaactcaggcgcgacgcggtgcgcggcttgttccaggtgaccatttaacgacgcccgcaaggcatcatcggcaattaacgtttcgccaaaccattgacccgcccgcgcgatacgttctttcacacgagaatcttcactgttgatatccgctttcagccactcccgtaaatccccccacaattcactgagatagcggttaaaagcttcatcttctttcagataactttttacggcatcggctcgcgctgccatttccggatcgtttttcaacttgtcgatcagggcaaaagtggcgcgatcaaacgcatgacggatctgatgcgcacgatcacggctgatatcatcaagcaaagaattcaccgcgtcagaaaccaactccgcgctatgttcgcccaaccattcggtggggagaattttggctttcagtggatgctcactctccagccagcgaacaatttgctgggcaataaacttgcgcgatttatcgcgctggagaagggcgatcaactgtgcgatcagcgtatccagtagcacctgatgacgatcgtttttggtcatactctccagcatcaacgcactggtgccggaaagatcgaccttatcaatcgcccgatggaccgcgcgcttaagcaggcgctgaatacgcgcatcatcggtcagttcaagaaaaccgctcatgatctgcaacagatgctgaccaacgcggcgggcgttttctggctgactaaaccagttgccaatcaacaacaccggttcgtggcgtcgaatcaatgccaccagcgactgggtatcgagaaatttttcctgcacgaactggccgagattttcgccaatccggtctttattacgcgggataatcgccgtatgacgagaaatgatcggaatcggcacgcggcgaaacagcgccaccaccgcaaaccagtccgccagcgcgccgaccatcgccgcttcagcaatcgccttcacgccgctcacccaaaaattgggcggcaaaaacagcgtaacgacaaaggtagcagcggcgataagcagtaaagagagcgccaacattttggcgcgtctgagttcaatgagtttattcataacgttaagaatagagcctgacggcaggatcgcgcaaaaatcaccgctcctccgccagctcggcagcctgatgttggcgcacgcggttaagcaatcctgccagggtgaaaacgacgataatgcccgccacgacggctaacagatgaaacggcaagcgaccgccgttaaaccacagccagcggccgatttcgactgagacagacatcaccatcaggatcaccatattcagcgatgcggagacggttcctttcggtaagttattggaaaaaagcgtaaagcggaataaggtcgggaagattaaaccaatcccgaaagcatacaaactggtgcccagcaccgaccacagccagacgtgcggtgacagcagattgccgataatcaacagcgcgaggccaaccagttgaatgggtacggcacgccagataaagcgcggttcggtcggatctttaacgaaacgcgccacgatggcattcgcgacaatcaccgcgccgaacaccggaacctgtgtccaggcgaactgcgaagttgttaagccgcctgcgtcaatcaggatcaccggcgagacagccacccaactcatcattgggatatagcttaaagagatggttgttgcgccaaagaggaacagccgattgcaaaagacattacgaaaatcgcgcaagacgcttttggcgctaaatggaaccgcgccgcgcttcaccgtctcaggcatcgccagcagtaagccaacaaatgagataaaacccataaccgcaatgatggcaaaaaggactttccagtgcacaaagtgcatcagagctgcgccggaaagcgggccaataatcggcgcaatcagtacgatggaggtgataatcgccatcaacttaatcccttttgtctgtccgaacgcctcctgcaccgtgacataaccaacggtagcaataaaacagatactggtgccctgaattgcacgcgcgataagaaactgtgtcattgacgtggtgaacattgtcgcggcgcaggcaagggtaaaaattaacgccccggtaatcagcaccggcctgcggccaattctgtcggaaagcggccccagcagccactgtaacgccataccgccagcaagatagagactgacggcagcaggggccagactgacatcggcattaaaatcacggaccacattaatgatccctggctggatcagatccgtcgacagatacgcagcaaagtcatacaaaatcaacgccatcgggaaaaacagcgtggcggcatggcgggcaaaaaaacgtggcataacaaacaactccttgtccggagaaccccaatggggaaaacgaaattcaataccgtcggtaatgactaaaggcaggcgagaaggacaaatgtactgaatttcatgtaatcaaccacactgcctgtgaacacacagacagagaaataccttctgactccaggtcagaatgtataacgattacaaatagtcatcagcacattacccctcttgaattgatgggttgcatagaaaacatacaccttaagtgtaattaaaatttgcggttaatcaaaagagtgcggtggaaaggggaatatctgccgggtacaggaaatgtaaaacgcgagcctgtttccggaaaaatgtatcgtttgcagaggaacaaaaatagcctggaaagcgcctcggggaacgagaaattgccgggtgagaatggttttgttagtcgctacagtcgggccatcttatctacaggtgacggatcgccatgacaaacttcacaaccagcacgccgcatgacgcattatttaaatcctttctcacgcaccctgacaccgcgcgggattttatggagatccacttacccaaagatttacgtgaactgtgcgatctcgacagcttaaaactggaatccgccagcttcgtcgatgaaaaattgcgggcgctacactccgatattctgtggtcggtaaagacccgtgaaggtgatggttatatttacgtagtgattgaacatcagagccgcgaggatatccatatggcctttcgcctgatgcgatattccatggcggtgatgcagcgccatatcgagcatgataaacgccggccgctaccgctggtcatcccgatgctgttttatcacggtagccgtagtccttatccctggtccctgtgctggctggacgaatttgctgacccgaccaccgcacggaagctttataccgcagcgttcccgctggtggatgtcactgtcgtgccagacgacgagattgtgcagcaccgcagagtcgccctgttggagttgatccaaaagcatattcgccagcgcgatctgatggggcttatcgatcaactggtaatattactggttacagagtgtgctaatgacagccagataactgcgctgttaaattacattttactgactggcgatgaagcgcgttttaagaagtttatcagcgaacttacccgtcgaatgccacaacacagggagcgaataatgacgattgcagagcgaatttataatgatggatggctgttggggatggaaaaggggaaagaagaaggggaacaacgcctccttagattgttgttgcagaatggggcagatcctgaatggatacaaaagattaccggactttcgacagagcaaatgcaggcattagagcagcccttgcctgaaatcaagcgcgatccatggatcgaatactaatcagagacggatgacaaacgcaaagctgcctgatgcgctacgcttatcagacctacatttcctctgcaatctattgaatttgcgcggtttgtaggccggataaggcgttcacgccgcatccggtatgaacgaagcacactttgcctaagccatgctggaacgtggcgatgaccctgcaaagatacaacgagttacaggcgattcgtgagaggaaatcaggtgcttcgccactaattcgaatttattccattgcccgatacacggcctcgccaatttgctttagtgcttcgcgataggtttcgctgagcggcaaagcgcagttgatgcgtagacaattacggtatttgccggaagccgagaaaatcgagcctgctgccacctggatattcatgcggcacagctgccgcgcaacgcagaccatatcgacctgttcaggcaattctatccacagtaaaaatccgcctttcgggcgcgtaatacagatttcgcagggaaaatattcccgtatccagcaggtataaagcgccaaattgcgctgatagttctgccgcatccgcctgatatggcgatgatagtgaccttccagcacaaacgttgccgccgccatttgcgtggacggtacattaaagctgctggtggcatatttcatatgcagcagtttatcgtgatatcgccccggtgcgacccagcccacgcgcaggccaggtgcaatacttttactgaacgagctgcacaacaacactcgcccgtcgatatcccatgaatggatggtccgcgggcgcggatactccgttgccagttcgccgtagacatcatcttcaaaaatcacaatatcatgacgctgagcgagagagagaacggcccgtttgcgtgcgtccggcataataaatcccagcggattattacagtttggcaccagaatgatgcctttaatcggccactgttccagcgccagttccagtgcttcaacgctgatgccagtttctggatcggttgggatttcaatcactttcacgcccatgacgcgcagcatctgcattgaaccgtaataacagggggattcgaccgcgacaatatcgcccggtttacacaccgccattaacgccagcgacatcgagttatggcagccgctggtgatgatgatgtcatcggcggtgaccaccgagccgctgtcgagcatcaggcgggcaatctgctctcgcaatacccgctgaccggctaacaagtcataaccgagcacggtttgcagattatgctgcaccacccggcttagctcccgccagagcggtttcaggctgggcgtttcgacatccggcgtgcttttgcttaacggaacaatggaactgtcgctatgcgccaccagcatatccagcacctgatcccactgggtaatttccaccgggcgctgcaccggacgcgtcatcggcggcactggcggctgggctttacgttgtgcgacaaaataacccgaacgcggctgcggagtgatgagcttcatcgtttccagcgtctgatacgcctgttgcacggtgctgatgctgacgccgtgctcctgacttaagctgcgcaccgacggcaatttctccccgtgacgatacagcccttgctcaatccgctcggcaagtagagtcgccagatgttgataacgcgtcatgctgtattccttatttggcccatacagaaagaaaaaccggtacagatgaggctaaaaaaccggatgcagatgctgttttaacctgtctgtatgttaaataaaactaatatttgcatctgtattgtgaactgccagaaggcggatgatgaagcctctgaaagatgaggaggcagcagatggaatttcacgaaaacaaagccaaaacgccgtttatcagacttgtgcaactctggcaggcggtgaggcgttggcggcggcaaatgcaggcccgacgggtgttacagcagatgagtgatgaacggttgagggatatcgggttacgcagggaggatgtggagtgaactatgggcggcgtgttggcaaatgctgcctgtctgcattcaaaattgctacaaaatccaaccataaaagtcgtttacaacatatttttctgatttacatacagataatgacctgagctgtctctctgggggtcatcatctatgcgtccgggggatctgtcacaaaaaggaatagaacaaaatcatcagcggtgaataaagcgattcgttttagatcacattaatgaaatttttgtatcaaaaattagttatcgcgctcacagttcataatgaaacaattctctgcaaatagataaccgaagcttcgttgctagtatcaattcgctaattatacacctgccagaggatacaatgaaaaatagaaatcgtatgatcgtgaactgtgttactgcttccctgatgtattattggagcttacctgcactggctgagcagtcgtcaagtgagataaagattgttcgcgatgaatacggcatgccgcatatttatgccaatgatacatggcacctattttatggctatggctatgtagtagcacaagatcgcctttttcagatggaaatggcacgtcgcagtactcaagggactgtcgcggaagtgcttggcaaagattttgtgaaatttgataaagatatccgtcgtaactactggccggatgctatccgggcgcaaattgatgccctttccccagaggatatgtccattctgcaaggctacgctgatggaatgaatgcctggattgataaggtaaataccaatccagagacgctcttaccaaaacagtttaatacatttggctttactcctaagcgctgggaaccgtttgatgtcgcgatgatatttgtgggcaccatggcaaaccgcttctctgatagcactagcgaaattgataatctggcactgctaacggctttaaaagataaatatggtgtatcacaaggcatggcggtatttaatcagttgaaatggctggtaaacccatcagcgccaaccactattgccgtacaagagagtagctacccacttaaatttaatcagcaaaactcgcaaacagcagctctgttgccacgctacgatttacctgcaccaatgcttgaccgaccagcaaaaggggcggatggcgcactgctggcgttaacagcagggaagaaccgggaaactattgctgcacaatttgcacagggtggtgccaatggtctggcggggtatccaacgaccagcaatatgtgggtgatcggcaaaagcaaagcccaggatgcgaaagcaatcatggtaaatggtccgcagtttggctggtatgcgcctgcgtatacttatggtattggtctgcacggtgctggttatgatgtcactggcaatacaccatttgcctatcctgggctggtttttggtcataatggtgtgatttcctggggatcaacggcaggtttcggcgatgatgtcgatatttttgctgaacggctgtcggcagagaaaccaggctactacttgcataatggtaagtgggtgaaaatgttaagccgtgaggaaaccattacggtgaaaaatggtcaggcagagacctttactgtctggcgtacggtgcatggcaacattctccaaactgaccagacgacacaaacggcttacgctaaatcccgcgcatgggatggtaaagaggtggcgtctttgctggcctggactcatcagatgaaggccaaaaattggcaggagtggacacagcaggcagcgaaacaagcactgaccatcaactggtactatgctgatgtaaacggcaatattggttatgttcatactggtgcttatccagatcgtcaatcaggccatgatccgcgattacccgttcctggtacgggaaaatgggactggaaagggctattgccttttgaaatgaaccctaaggtgtataaccccctgtcgggatatattgctaactggaacaattctccccaaaaagattatcccgcttcggatctgtttgcctttttgtggggggggcagatcgcgttacggagatcgaccgactgcttgagcaaaagccacgcttaactgctgatcaggcatgggatgttattcgccaaaccagtcgtcaggctcttaacctgaggctttttttacctactctgcaagcagcgacatctggtttgacacagagcgatccgcgccgtcagttggtggatacattaacacgttgggatggcatcaatttgcttaatgatgatggtaaaacctggcagcagccaggctctgccatcctgaacgtttggctgaccagtatgttgaagcgtaccgtagtggctgccgtacctatgccatttgataagtggtacagcgccagtggctacgaaacaacccaggacggcccaactggttcgctgaatataagtgttggagcaaaaattttgtatgaggcggtgcagggagacaaatcaccaatcccacaggcggttgatctgtttgctgggaaaccacagcaggaggttgtgttggctgcgctggaagatacctgggagactctttccaaacgctatggcaataatgtgagtaactggaaaacacctgcaatggccttaacgttccgggcaaataatttctttggtgtaccgcaggccgcagcggaagaaacgcgtcatcaggcggagtatcaaaaccgtggaacagaaaacgatatgattgttttctcaccaacgacaagcgatcgtcctgtgcttgcctgggatgtggtcgcacccggtcagagtgggtttattgctcccgatggaacagttgataagcactatgaagatcagctgaaaatgtacgaaaattttggtcgtaagtcgctctggttaacgaagcaggatgtggaggcgcataaggagtcgcaggaagtgttgcacgttcagagataattaagcccgaatgccctcatattctggaggaatatgagggtgataaagtctcaggtattgtgatgttggagggctggttactttttgagtcccgcaaacgccgcccgaatctcatcctccggcaactgaatcccgataaacaccatcgtgctatgcggtttttcatcgccccatggcctgtcccagtcggcgctgtagaggcgctggacgccctggaacagcaggcggttaggttcgccgtcaatccacagcatccctttgtaacgcagcagtttatccgccgattccagcagcaggttttccatcacccgggaaacttcgctgatatctaccgggtaatccagttccaccacaatcgacgaaatatcgttttgtttatccgcgataaagtggaaacgcggtttggtgctgacgacgttttcttccagcataaaaccgttggtgttgaacagcaggcccaggtcgatgtcgccgtgggtgacggtgtagaccggtgcacgggcgttgatgcgcgccaggcgttcacgcagtttttctgcttcgcctgcgacgtcggttttagtcagcagaatacggtcggcgtagcccacctgggactgggcgatggtgaactggttcatctgctcatcggcatgtaccgcatccaccagcgcaatcacgccgtccagcaggtagcgctggcataaaatctcatgggagaaaaaggtttgaataatcgggccaggatcggccatgccggtgcattcaatgaccagacgatcgaactgaatattgcccttgtcgagattatccagcaggtcgagtagcgcgtcctccagctcgttggagcgcgaacagcagatgcagccgttggtcagcgttttgatctgcgttgcgcgatcaccaatcaattgatcatcaacggagacttcgccgaattcgttttcaatcacggcaatcttgtagccgtgttgttcattaagaatatggcgcagcagggtggttttgcccgcgcctaaaaaaccggtgagtagggtaactgcaatcgggttcatgctctctccattaacaacagcgcataccgcctttaccatcgccgccgtagcgcgcgttctggcgttcgcggaagaattcttcatagctcatgtacggcttgtcgggatggttggtcttcatatgctcgacgtagttgtcgtagtctggaatgccaatcaacatcttcgccgcctggccgagatatttttttgcctgtcctaagttaccaaacatagttcactctgatagaacaaagccccgccgaagcggggctaaacacggttagtggtgcgaagagatcttcacgccgccttccgggattggaacgtacggagtttctttgtcagtacgtttgtcgctgttacgcaccgcaagccaggttttgaaaccgtagaagatgatgctgtacaccacaatcaggaacagaatactcaggcctgcgttggtgtagttgttcacaacgatgtggttcatgttggcaatctgctgcgccgtcaggtcagtaccgttagcaatcttctctttgtactggcttgccatgtagaagaagccttccatctgcgggttggtgctgaacagtttcagacccagcgcccaggtggtgcaaataagcagccatacagccggaacaacagttacccagatgtattgggtgcgcttcatcttaatcagcacaacggtgcccagtaccagcgctacggctgccagcatctggttggagataccgaacagcggccacaggctcttaacgccgcccagcggatcgaccacgccctgatacagcaggtagccccacagacccacacagcccgcagtaccgatgataccagcaaccagagagtcggtttttttcaggaacgggatgaagttacccagcaggtcttgcagcataaagcggccagaacgggtacccgcatccagcgcggtcaggatgaacagggcttcgaacagaataccgaagtgataccagaagcccatgtcagccatcggcagcactttgtggaacacatgagcgatacctaccgccagcgttggcgcaccacctgcacggttcaggacagaaggctcaccaatgtctttcgcggtttgcaggatctgctctggcgaaatcacgaagccccaggagctgacggtcgctgccgcgtgtgcggtaacgtctttcagctgcgccatgatgatcggcgcgttctcgccacccatttcatgcaggttaggcatggtgatgccaaggcccgcaggcggggtgttcatcgcgaagtaaagacccggttcgatgatggacgctgcaaccagcgccataatcgccacgaaggactccatcagcattgcgccgtagccaatgaaacgcgcatcggtttcgttagccagcagtttcggcgtcgtaccggaagagatcagcgcgtggaagccagataccgcaccacaggcgatggtgatgaacaggaacgggaacagagcgcctttccacagcgggccagtaccgtcaatgtactgggtcatcgcaggcattttcagttccgggttcagcaccacgatacccagcgccaggccgacgataacgccgattttcaggaaggttgccagatagtcgcgcggtgcgaggatcagccacaccggcagcagtgcggaaacaaacgcatagccaatcagcgcgaaggtaatggtggtgtctttaaaggtcagtgccggaccccagtacggatcgtgagcaatcacgccaccgaagtagatagaggcaaccagcagcacgataccaataacagagacttcacccacacgccccggacggataaagcgcatgtagatacccataaacagcgcaatcggtacggttgagcaaacggtgaagacaccccacggactttcggccagggctttaaccacaatcagcgccaggacggcgaggatgatgatcatgattaagaaacagccaaacagcgcgatagtccccggtactggtcccatctcttctttgatcatctcaccgagagatgcgccgttacggcgagaggagataaacagcaccataaagtcctgaaccgcaccggccagtactacccccgccagcagccacagcgtgccaggcaggtagcccatctgtgcggcgagaaccggaccgaccagcggaccagcaccggcgatagcggcgaagtggtgaccaaacaacacgtaacggttggtcggaacgtagttcagaccgtcgttgttaataaccgcaggcgtcgcgcgcgtggggtcgagtttcatcaccttctgggcgatgtacagactgtagtagcgatacgccaccagatacaccgacacagaggcgaccacgatccacagggcgctgacgtgctccccccgacgtaatgcaactaccgcgaggcagaatgcaccgatgattccgagaatcacccagggtatgtgcttgaatagttttttcgtatccatagtaaaacctggcattttactcgtcgtcttttggcttacaggtgcggcagttgcgttcgttcacccctgtcacttactgttgtaagctcccggggattcactcacttgctgccttcctgcaaaccaaaattcatagagtaatttgttaatcataggccgaagccgttctaggtttgcgttgcgtttgaggaggtaaattgaccgctatcctgcagtgatgttgccagagttacgcgcgcgtaaagtaaggtaaataactgagtggttattttagggacgtaagcggtcaggaatggcggtgagcggttgggcaagaattattcatcgggtggatatgtgattgagatcacaataaaaatgccccttcgacgaatgcgtgaaggggctggagcttaaatcgcagcttccatttccagcatcaccggatggaaacggcgtttaaagtagataagtccgtgaccttctgcactgaggatgatgtttttaatctccaccagatacaccagatgtgtgccaattgcctgcacatcgcggatctcaccttcaagactggccagcgaacctttcagcaccggctgcgccagcggacctttttgccagcatgagaggctaaaacgctcttccatcgccatgcctgtcatgcccgcgaagtggcgtgccatcagttcctgctcatggttgaggacgttgacgcacaacttaccgttgccctgaaaaaccgggttcatcgcactgttggcgttaatgcacaccatcagcgatggtggtgtatccgtgaccgagcagacggccgttgccgtaatcccgcattgtccggcgtcgccctcggtggtgataatatttaccgctgccgacaggctggccatcgcgtcacgaaagcgcaggcgctgttcatctaattgcatcttaacctcctgctgcgttatttcagcagcttatccagcatgttgatatcgtcgttgttgtgcaagtgcggcacagtccagccgttctggtcgtattccgacaggcagcgatcaaccatcgccatcatcttgtccatattgccggagctttgtgcctggcgcagacactgtaggcgaatctcatcctggctaccggagtagttgatttcatacagttcgtggcgaccaccaaactcgctgccaatggcgtcccacatcagtttgaggatcttgatgcgctggacgtgatccataccattcgaaccgcgcacatacttcgccagatactggtcgatctgcggattgttcaggtcacgggcactggaagggagatagatcaggccactggtaacgttgcgttcgataatgtttttgatcttcgcgtaggccattggtgccagtacgcgataggtttgcagtgcggcatgatccggtaaataagccccgttgacccacggcgtcgcttcagaacacatcgagtcactcaatgcccagaaggtgttgcgccacgccaccacttcaccgagatcggcctgtacaccacggaactccagggtgccggtacattcgagtgattttttcagcagtgctgtaatgaagtcgagtttcactgccaggcgcacacaggcttgcagcggatacatacgggcaaaaccgccttccattgtccagcgacggcagcgatcgaaatcgcggtagatcagtacgttttcccatgggatcagcacgttatccatcaccagaatcgcatcgttctcatcgaagcggctggagagcgggtagtcgtatggcgagccggtagcacccgcgaccatctcataagaggcgcgggagattaatttcacgccatcggcatccattggcgcaacgaacatcagtgcgaagtccgggttttcgcccatcacttgtgccgagccgaagccaatcatgttgtagtgagtcagcgccgagttggtggcaaccactttcgcaccgctgacgataatcccggcgtcagtctctttttccagcttgatgtaaacgtcttttactttatcggtcggcaaatgacgatcgatcggtgggttaacaatcgcgtggttaaagtagaggccagtttcctgaatacgggtgtaccagttacgggcgttctgctcgaactgaccgtaaaagcccggattcgcgcccagtgcgcaaccgaaagcagctttgtagtctggggtacggcccatccagccatagctcaggcgtgaccactcagcgatggcgtcgcgttgctggcgcaggtcgtcggcacttttcgccacgcggaagaatttatgggtatagccgccgctgccggtgtcggtgttccagcacagagagtcctgcatctccggtttgtgcagcgcgtcgtacagttgggcaacagacgctgccgcattacgaaatgccggatgagtagtgacgtctttcactcgctcgccatagatatagatctcgcgaccatcctgcaggcttttcagatactcttccccggtgaacggacgttgggtactggcgcggaaatcttctggtttcatgtcgacctctacagtattaatcggaatacgattgttaattttgtgtgttgtttttgttattcaattgaagcttgcaggggcgattacgggaagacacttttgggacaatggctggtacttttcaggtcgggtacggttttgtgatcgaggtcgcttttagcgatttttgacgttactaaatccccttgctccaggcggagaaaggggaatagcaggtggtgcctggtttcccgttaaggctaagggattttcacgtcacaggtacttttttggcacgataagcactgggcgagcaaccgactaagcgattaaaaaagcgcgcaaaataagctggatccttaaaaccgagttgccaggcaatattgttcacggcgttatcagaaaacagcagcagccgcttggcttctcgcagctgcctgtcgaaaatcaaccgttttggcggacggttggcaaagcggcggcagatgtccgtgaggcgtgattcggtgatatgcagttcgttagcgtaatccggtactgtccagtgctgatgaaaatggctttcaatcagcatatgaaaacgctggaacagttttaattctccgcgcattccgctggcggcatggtcgtcgagttttgcgttacgcagcagtagggtgaacactgcctgtgccagtaacgtcagggtgtgttcccgtccaggcagttgttctaccgattcccgctctatcagttgccaatagtgttccagcgccgccagttcgtcgggtttatctgccagtgacaggcaaatccccggcaggccgaaggtttcccgagtgcctggataaagaacttccagcaggggccagatcagatcttcccgtaccgtcaacacatgaccgtcggcgtcagactccgtaataaacgcatgaggtactgacggcggcgtcaggacaaacaggggcgcttccaccgagtagcgatgatcgtcaagctgtagctcaatctgtccgctattgaggaaatgcatctgaaagtactgttcgtggcgatgtggcagcatatggcggccaaaaaatgccgccatgcgggcgaaggactgataatgcacatcgtccgtgcccaggctttcatcgtactctttgctgatatcaatattggcaatctgacggtcacacatcgtcgttccttacggggtcgctcgcggacgggaggactgcattggaattgcccagataatccccgcaccaatcaccagcagcgcggcaacaaaccacaatccactgttaaagctgccggtcagatctttcaaccagccgatcataaacggacttaacgctgagccaatgttgccagtggcgttgatcaccgcaataccgatcgctcgtgcccgcaggctgatggactgatcaggtgttgtccagaaaatcgccattgcgctgaatgatccggtcgaagccataatgatccccagcatctggatcatgttgtgatcagttgccgaagccagtaaccaacccgcggcagcgaacaaataaggaagggcggtgtgatgccttcgttcctggcggcgatctgagtgacggctccagtagatcatcccgagaatggtacaaatctgcggtacggcggccagcaggccgatggtgatattactgctgccctgattaaagctttgcaggatctgcggtgtccagatgctgatcgcactaagtgtgttggtcaggcagaaatacgccagggtatacatcatcaccaccggagtgaagatctcccgccacatgctgcgttgttgcatggcgtggtggctgatggctccctctggctgaaccagcgtcagacgatcgttatccatcatctcttgcaggcattttttgtcttctttcgtcagccacttagctttgtccggtgagtcatcaagccagaaccacaccatgacgccgagtaataccgacgggaagccttccagcaaaaacagccactgccagccttttaatgccattacgccatccagcgacaaaatgtagccggaaacgagcgatcccaacgctgtcgttaccggcattgcaaccataaacaaggcgttggcacgggcgcggaaataggctggaaaccagaaggttaaatacagcagaatgccaggcagaaagccggcttcggtaatgccaaccagtatacgcagtacgtacaagctggtggggccagtggcaaacatggtggcagtagaggcgatgccccaaagcaccatgatggtggcgatccagcgccgcgcaccgacaatactcagcataatgttgctgggaatgccgaagatgacataagcggcgtagaacagggtggtagcgaggccaaacatggtggcgctcagaccgaggtcgcgtcccatcgtgagtccggcaaagccgatgttgatgcgatcaaggaacgagaagataaacagcacgaacagaaagacgatcaggcggcgaaatagcttcttaataaccgcctgttgtccggcagtcagcgctttatgctgattcgccggatcgatactctccggtatggcaggtgaggtgtcgctcatttttcttcctctaatgggatttttgtagggtacgacaaggtttttgctggatgcggcgtaacgccttatccggcctacgatttggtgcgagtgtaggccggataagcgcagcgcatccggcattaatacacgccgggcttcacggcggtagcctgcgcaccaaaccgtgctgccagcgcttcagcggcgcgggcgagcagggtggtgtcaacgccgacggcgacaaacagcgcgcccagttccagatagcgttttgccagttgctcattggcgatcaggatccccggtgctttgcccgcttcgcggatctgcacgatcgcctgctcaatggcggcctgtacttccgggtgctgtggattaccggcataacccatatcggcgctcagatccgccgggccgataaacacgccgtcgactccttccacgtccagaatctgcggtaagttcttcattgcctcacgcgtttcgatctgcaccagcacgcacatttgatcgttggctttttgcaggtaatcaggaatacgattccagcgcgaggcgcgggccagcgcactgcccacaccgcgaataccggcggggggataacgggtggcgcgtaccgcttcacgggcttcgtcagcgttttgaaccatcggcaccagtaaggtttgtgtgccgacgtccagcagttgtttgatttgcaccggatcgttccacgacggacgtactaccggctggctggggtagggcgcaatcgcctgtagctgggtgagcacggtttgcacgttattcggcgcgtgctcaccgtcgatcaacaaccagtcgaatcctgctccggccagtaactccgcgctgtagctgctgctcagccccagccataatccaatctgcggacggcctgctttcagcgccgctttaaaactgttttccatcgttctctccttaaacaaagcggcagctaatggagcccatgttgccgtaatcgacgtggaaggtgtcgcccttacgcgccggaaccgggcgggtgaacgaaccgccgagaatgatttgcccggcttccagttgtacgtcatacggtgcgagtttgttcgccagccaggccacgccgtttgccggatgattcagcacaccagcggcgacgccggtttcttcaatcacgccattgcgatacatcagggcggagatccaacgcagatccagttcgtctggtttgatcggacgaccgccgaggatcaccccggcgttggcggcgttatcggaaatggtgtcgaacactttgcgcgggcgctgggtttccggatcgatgttgtggcagcgagcgtcgatcagctccagcgccgggatcacgtagtccgtggcgttgtagacgtcgaacagcgtgcagtttggcccacgcagcggttttgccagcacgaaagccagctccacttcaatgcgcggcacgataaagcgatcggtcgggatatcgctgccatcgtggaagaacatgtcatccagcagggcaccgtaatccggctcgctgatttgtgagctggcctgcatcgctttcgaggtcaggccgattttgtggcctttcagcgtgcgaccttcggctattttcaggcgaacccattcacgctgcaccgcgtaagcgtcttcgatggtgatctccgggtaatccagcgagatcgcgcggatctgttcgcgctgtttttctgcctgatccagacgctgggcgatcagggtgtgggtatgtttatcgaacatagcgatatcctgtggcattgccggatgcggctgcgccttatccggcctacggtgtacggtttggggttttgtaggcccggtaagcgcagcgccaccgggcaatctgcgcgctacttaaacaatgcgtgcacgttgttttgtttaaaattcagcgtcggatgcagctcttcaatctcaaacgacaacgccagcaggcggctctccatcagggcggcgaagtgcgttttaatcagttcaaacagcatttcacccgcctgctgacggctttccaggctgcgacctgcgccgattttcaacgtcatatgcacgaaggcataatcacgctgcccgtcggccatctgccaggtatcgacccaatgcacgcggctgcgaatacccgccagcggaaaaatacccgtggctgccagcgtcggattcactttggcgaacaaccccggcaggtcggcttcttcgcggatgttgtcactgcattcaacgataaagtgcggcataaaacgtccttacgcgggaagcgggaaaacagcgttaacctgaccggtgccagagcttgggaatagctcggtgataaactccaccttgccgtcgtatttatcccagccgagcatccccagcagcatcaccgtgtcgtgcatattgccttcgccgtagcagtagtcggcgtactccggcagcatattgcagaactctttgaactggccttcgcgccacagcttcaccacacgctcgtccatctggcggtcgaactcgcgggtgtagctgttcatcccttcttccgctcgctgatcgtcaataaagcggtgcgataacgaaccgctggcaaggaccgccacggtgccgtcgtactgttcgatcgctttcagaatcgcctcgcccagcttgcggctgtcggcaaaatcgtgaacagtgcagaaagctgaaatggaaaccactttgaagtgcttgtcttcattcatgtagcgcattggcaccagcgtgccgtattccagtttcaggctgggaatgttgtgcgcttttgcccgcacgccgagctttaaggcttcatcggcaataagctgccccaactccgggttgccctcgtagttgtaggtcatatcgcggataaaatgcggcagctcgttgctggtgtagacgccttcaaaatggtctgcacagttgatgtgataagcactgttgaccagccagtgggtatcgaaaacgataatggtatcgacgcccatttcccggcaacgcttgctgatctctttatgcccgtcgatcgcgccctggcggcaaccgtggtttttccctggcagttcagagagatacatcgacggtacgtgcgtgatcttggcggctaacgctaacttacccatatcagactccccatttcggaattggatggtcgcccatggaaatgcagacgttcttcatttccgcgaacacttcgaagctgtactcaccgccttcacgcccggtgccggaggcttttacgccgccaaatggctggcgcaggtcacgcacgttctgggtgttgacgaacaccatgccagcttcaatgccacgcgccaggcgtaacactttgctgacatcctgtgtccagatgtacgacgcgaggccgtactccacgtcgtttgccagacgtaagccttcggcttcgtctttaaacggcagcaggcaggcgaccggcccgaaaatctcttcctgggcgactcgcatacggttatcaacgtctgccagcacggttgggcgcaggaagttgccgcctttcaggtgcgcaggcaggtcggacggtttatccgggccgcccgccagcagggttgcgccttcttcaatgccgagacggatatagccggagactttttcccagtgctgctggctaataagcgcgccaacctgggtattcggatcgttcggatcgcccacgcgcagacggttggcgcgttcggcaaagcgtttaacgaattccgggtagatgctttgctgaataaagatgcgcgaaccggcggtgcagcgttcgccgttgatcgagaagatggtgaacagggcggcgtccagcgcgcgttcaatatcggcatcttcaaaaatcagcaccggcgatttaccgcccagttccatggagtattttttcagcccggcgtttttcatgatgttgcgcccggtggccgtaccgccggtgaacgacacggcacgtacgtcatgatgacgaaccagcgcatcccctgcggttgcgccgtagccctgtaccacgttcagcacgcctgccggaataccggcttccagcgccagctcacccaggcggtcagcggtcagcggggagagttccgacattttcagtaccgcggtattgcccagcgccagacacggcgcgaccttccaggtggcggtcataaacggcacgttccacggtgacaccagtgcacaaacgcctaccggctgcaccagcgtgtagttgagcatcttgtcgtcgaccggataagtcttgccgttcatctgctggcagacttccgcgaaaaattcaaagttgtgagaagcgcgtgggatcaacacatttttggtctgatggatcggcaggcccgtgtccgcggtttccatcgcggcgatctccggcacgttctggtcgatcagatcgcccagacggcgcatcaggcgcgcgcgctctttcatcggcagattggcccatttcgggaacgcctctttcgctgccgctaccgcctgattgatctccgcttcaccgccggaggccacatccgccagcacttcacccgttgccggattggtagtctggaagtagtcgttacctgcaacatttttaccgttgatccaatgatttacttttttcatttcgctgtttcctcactcacaattcggttcaccaggcggcccacgccttctacttccaccaccacttcatcgccaggcaccacgtcagataagccttttggtgtgccggtggcgatcatgtcgcccggattcagggtcataaattcgcttaagtaggcgatcaggaagggcacgctgaagatcagatcggcggtggtgccttgctggcgtaactcgccgttgacgaaggtgcgaagggtcagattatgcgggtccgggatcgcctctttcggcacgatggttgaaagcatcggcgtcagtccgtcgcggcttttgacccgcaggttagggcggtagtagttttccagatagtcgcgaatggcgtagtcgttacacacggtgtagcccgcgacataatccatggcatcggcttcgctgacgttacgcgcctgtttgccaataactaccaccagctccgcttcatagtgcatgtattcaatattgtttggacgcacggaggtctggttatcgccagtgagggtatttggcgctttcaggaacaccagcggttcttccggtggcttaaattccagttcgctggcgtggtcggcgtagttcaggccgagggcaaacagcgtgccgtgcgggtgtggctgcgttgggaagctcttgcgcgtggtcacttcacgttcgtccactaccggattttccagcggcgggaaaccttctgcgagaacacgaacgcgatcgcctggctgtatttccacgcgcgcctgtggcgtgccgagcagaatggcatcgcctggattcagtgtggcaaattcgctcagggcgctcagcaactgcgcggcgttacgttgtaaatcggcggtattccagtgatcggcaggacgcccgttgatctcggtatagatggtcagattatcgacattgctgagagccacggtttcgccaatggggcagaatccatcacgacattttgctttgattgccgggcggtaaaagctctcttccggcaggctgacatcgttagccagcgcatatccggcgatgtactctgctgcatcttcttcacgtattttcgtcgccgtttttcccacaatcagcgcaacagtcgcaccgctcagtaccttttcaccctgtggaaagggaatcggttcaccgcaaccaatcaccgtattgcgcggtttaataaaccagaccgcagttttaggcggggctttgtagggggattgctggaacgcttcctgccatgcatcaagttggctgcgatggttcaacgctacggcgaagatagtgcctttcattaccactcctcggattcgatcattttaatcattaatatgttaatgattacttttattcccgattgcgtagtttggcaaaagtaagtgatgtaaatgtgatctaattaacaaactatttacatttaaagataataaaatattaaatatcagcaagttaacaaaacatgctcaattttgataaaatgaagaattgcaggggcagcgcagtcccggtaacgtgatgattaactgtttctatattaatgattttgaatttttcaggggaaagataatgcacgactctctaaccattgcgttgctccaggcgcgagaagcggcgatgagttattttcgcccaatcgttaaacggcataatttgactgagcaacagtggcgcatcgtgcgtattctggcggaaagcccatcaatggattttcacgatctggcgtatcgcgcctgcattttgcgcccaagcctgaccgggatcctcacgcggatggaacgcgacggtttagtgttgcgattaaagccgatcaatgatcagcggaagctctatatctcgctaaccaaagaggggcaggcgctgtataaccgcgctcagacacagattgaagaagcctatcggcagattgaagctcagtttactgccgagaaaatgcaacagttaacccatctgttagaggaatttattgctctgggcaattcccgacaagaagccatcccgggcgataatgaataactttttagtatctgataaccagcgcctggtttttccatggatggcgggttacaccttttcataaagtttttgctttccaggccgaaaatcttgcatcggtccacaggaaagagaaaccatgttaaaacgtatcaagatcgtgaccagcttactgctggttttggccgtttttggccttttacaactgacatcaggcggtctgttctttaatgccttaaagaatgacaaagaaaatttcactgttttacaaaccattcgccagcagcaatccacgctgaatggcagctgggtcgcgttgttgcagacgcgtaacaccctcaaccgcgcgggtatccgctacatgatggatcagaataatattggtagcggttcaaccgttgctgagctgatgcagagtgccagtatttcgctgaaacaggcggaaaaaaactgggcggattacgaagcgttgccgcgtgacccgcgtcagagcaccgccgcagcggcagagatcaaacgtaattacgatatttatcacaatgcgctggcggagctgatccaactgttaggtgcaggcaaaatcaacgagttctttgatcagccgacccagggatatcaagacggtttcgagaagcagtatgtggcttacatggagcaaaacgatcggctctatgatatcgccgtcagcgataacaatgcctcctacagccaggcgatgtggattctggtgggcgtgatgatcgtcgtactggcggtcatcttcgccgtctggttcggtattaaagcctcgctggtagcgccaatgaatcgcctgattgacagcatccgtcatattgcaggcggcgatctggtgaaaccgattgaggtggatggctctaatgagatggggcaactggcagagagtttgcgccatatgcagggagagctgatgcgtaccgtcggtgatgtgcgcaacggggccaatgccatctatagcggtgccagcgaaatcgctaccggcaataacgatctctcttcgcgcaccgagcaacaggccgcttcgctggaagagacggcagccagcatggagcaactgaccgcaacggtgaaacagaacgccgagaatgcgcgccaggccagccatctggcattaagtgcttctgaaacggcgcaacgcggcggcaaagtggtagataacgtggtgcagactatgcgcgatatctccaccagttcgcagaaaatcgccgatattatcagcgtaattgacggcattgccttccagaccaatattctggctttgaacgcggcggttgaagcagcgcgtgcgggtgagcaagggcgcggttttgcggtggttgcgggagaagtgcgtaatctggcccagcgtagcgctcaggcggctcgtgaaattaaaagcctgattgaagactcggtggggaaagtggatgttggctctacgctggtcgaaagcgccggggaaacaatggcggagattgtcagcgccgtgacccgcgtgacggacattatgggcgaaattgcttctgcttctgatgagcagagccgtggtatcgatcaggttggcttagcggttgctgagatggaccgggtaactcaacagaacgccgcgctggtggaagaatctgccgctgccgccgccgcgctggaagagcaggccagtcgcctgaccgaagctgtggcagtgttccggattcagcaacagcagcaacagcagcaacagcagcgtgaaacatcggctgtggtaaaaaccgtgacgccagctgcgccgcgtaaaatggccgtggcagatagcgaggagaactgggaaacattttaatcgccatgaaaatgcccgataagcaaaatgttatcgggcataaggagattaatctttacgtgggtcgttgatcggctgacgaaccaggaagatgtacgccagtgcccccgctgcggtgacgcaaccgcagatgattagtgccagacggaatgagtgggtggtatcaacaataaaaccagtaatgatcggcgcaaaagaggcgcagatgaagctggcaaagttctggatactgcccaccgacgcagtcatgcgagaagcaactgcgacgtggatcaagccccagcaggatgttccggcaaagtgaatacagaacagtgccatgccaatcagcagaaccgccgtcatggatgttgtcgcttgtggtactatcagcgtaaaggcggcagaacagaacatcccggcaataatgcagatcttacggcttttaatcggagccattccccctttgaccagccagtcagtaacgtaaccgttgaccagcatcccggcagccccaaacaggaaagggatagccgccatcaaccctgtgctttttaaatccaggttataggctgtttgcaggtaaccaggaagccaggccagatacagccacgcagtgtagttgatgccactgaatccgagcatcattccccacattgtacggttacggaacaggctgcgccattcggcaaaactgagcggatctcggcgggcattgacgctacctgcattgagataagcttgttcaacggcagtcagttctacgtgctcgcggttgcgatagagcatataccagccgatggcgagaaaaatccccagtacaccaatggtaataaacatcccgcgccagcccatcaccagcatcatcgccgccagaatcggtgggcttacggcaacgccaatggtagaagctgcgttgaagaagcccatcgggcgtccgcgctctttgatgttgaaccagtcgttaatgacttttacaccgcatgggttcatcggcgcttcaccaatccccataccgatacgcaccaacacgaactgcgtaaagttgtgcaccatgccagacattgcctggaacagtgaccagaagaacatccccagtcccagcatcaggcgtgggcctttacgatccaatagtgggccgcaaggaagttgcgcaatcccgtaagcgagtgaaaacacggagagcaaagcgccgatttcggtggcacttaatcccaattcttcacgaatcgttaaatttgctaccgacagcgaactgcggtcgagataattgattaccgccgcaaaaaataataacaacatggcggtggtttgaatgcgtttaattcgggtactgcgttgaactaatccatctggtggcacgggaatatctgccgacgaagatggagtaaatgaagaacgcggatcgagggtgatattttctttttccacgccggactcctgtatttataattttaattgtttacgtaattgtgaattacgcaaggttgacattaacggcaggttaaagttttaggactttactaccgctcacaaaaaaatttttagtcgactgattgtgagcataggtaagcgggaatttcccggtatttatcttttgataaaaccgtgcacccgctaatagtttgctgtttttaatccgtacttaatgagcataacgcgtgttctcattaatggatcgaatcattgattgtttagctgaattcaaatggttacggagcgcaagggtggcatcaaggtcactgcggcaaatcagagcgctgagaatggtcatatgctcatcgacggcaatgatattgcgctgtttaagatcgctttcgtcccattgatagtgaaaatgaaagatgactgagatgatctcaagcgattgatcaaaaaagatattgtcggcagctgaaagcagtaaggagtgaaaatctctgtcaagttgcgagaacatgcgaaagctattgccgatgttgtcacgcagtagccgatgacgttcgagcatggttttcgcctgcagccagcggggatcatgatcaggcaggttgagaaagtgctgaagtgaatgtgtttcgagcatttcgcgtagctcaaacagctgctcggcgtaggattgatcgaattgcttcatgctccactggccgcgtttttcgctttgaataagattataacggcctaattttaaaagatattctcttacaaccaccgggctgacacccgcggcccgagccagttgcagttcagaaaaagtttccccagggcgtaactgacgctggtttatcatcgtgaaaaaagcctgctcaaacactttgttttgttcactcattgaagcggtagtacaggcgaaagcgtcatcatggtcaggtttacgcgcaataacatagtcgtttccaacctgcgttaagacgccgcattcgcgtaagtggctgagaatatgacgcactgttgtgcggctgatgttgtacatttccgccagcgcactttgcgatggaagtggggaagggatatgaccccgcgccatatcatcaatgacctggttaatcacattgtggcgtaaattttgtgaacgactcatattttcctccttgtgagtccattaaaacccgatttaaaacatttttatgcgtgtgttttcacaaaacagattttccgttccgctgccatttttcattttcattgatatctaaggcaacaaaaaatggagagccgaatcatgtctacgatgaatgttttaatttgccagcagccgaaagaattagtctggaaacaacgcgagatacctattccgggtgacaatgaagcattaataaaaattaagtctgtcgggatttgcggtaccgatattcatgcctggggtggaaatcaaccattttttagttatccacgtgttttaggccatgaaatatgtggggagattgttgggctgggtaaaaatattgctgatcttaaaaatggtcagcaagttgctgtgatcccttatgttgcctgtcagcaatgcccggcgtgtaaaagcgggcgtaccaattgctgtgaaaaaatttcagtcattggcgtgcatcaggatggcggttttagtgagtatttgagcgtgccggtggcgaacattttgcccgcagacggtattgacccgcaggcggccgcattgattgaacctttcgctattagcgctcatgcggtgcgtcgcgcagccattgctcccggcgagcaggtgctggtggtcggggcggggccaatcggtttgggcgcggcggcaatcgctaaagccgatggcgcacaggtggtggtggcggataccagtccggcgcgccgtgaacatgtggcaacgcgtctggaattacctttactggacccgtcagccgaagattttgacgcgcagctacgggcgcagtttggtggttcgctggcgcagaaagtgatcgacgcgacaggtaatcaacatgcgatgaataacaccgtgaatttgattcgtcacggcggcacggtggtatttgtcggcctgtttaaaggtgagttgcagttctccgatccggaattccataaaaaagaaacgacgatgatgggcagccgcaacgccacgccggaagattttgctaaagtcggtcgactgatggcggaaggaaaaatcactgccgacatgatgttaacccatcgctatccgttcgccacgctggcagaaacctacgagcgcgatgtgattaacaatcgtgagttgattaagggtgtaattactttctgataaggcgagattattaaagttgccatgcagcgtccggggaagtgttgggcgctgttttttttctgtttctcaatgatgttttgtaggccggagaagatgtgtaggtcgcaccttatgcgacctacacatcagtcagaaattacccttcacgttccacaactttaatttccaccatgccgatcccgagcttacgcggcgagtgtccgaggatattcccttcgttggttgagacaggttccggcggcacaattaccagtgtgtcggcatcggttgggttatcgaaatgcagtgtggtggtggtcacttcattgcccagcacaagagtttgttcttcattgcctacgcgtaccggaataggacggctggcgttattgccgtatgctttggcggtaatcaccaggtcaaatttcttcggcagcggatgcttgtactcgatttttacttcatcgcccagctgcgcgttggaccagcggccccacgactctggacgggaaatcccactaaactgtttcacctcttctggcgcaccggcgacgttgaagatgaaactgtcggctttgtagcgaatatcgttatcaacaattttcagcgtatcgacattgcctttataacgcgccatgtcgatgaccgtatctttaaatgccgttttgccctgccatgttgttttgtcaacatgctgaacaatttgctgaccgccaagctgcccttgcgagacacaccagtcggtggagagtgccagttccggagcccagagttgtgccatcttatagcaacggtcaacccagacgaaattgtcgcgtggagcgaaatcggccagctggaaacgcagcggtgctgagtattcgctttccggcagcggttccacgcgtttgtctgaaacccgcaacagcagcggcaaacggaaatggctacccgagaaggcaatcatgtttttctgctggtcgatggtgaactctttcatctctttagggaatttccacaggcggatgatatccggcttccacgccaatgttttctctttgatattgaggaagatttccgacattgactgcccggataaactgctacgaccaagtccgagatagttatcgccaccgagaatgtccagcaccgtcgcgccgttatccatcgtgttacgcttcactgccagcgtctcttgctgcggcttgtcgccacgaatgacaaaaaacaggttattgcgatcctgcttattaaggtatttccacgccgtgttgttcatcgctaaatggtcagaagagacgacgatgacggtatctttaaaccacggtgacgctttgattttgttgataaacgccgcgatattctcctggctgcaacttaccgcgctgaatgactggttcggcttaccgtcaaaatcatattttttgcggttacaggtacgcgagataaaaccatccgggtgatgggtatcgactgtcagggtaaacagtgagaatcgctgacctgagcgggaaagctcttcaaactttttccacgcttcatcgagaacggtatcgtcgtagaatccccagtcgttgcgatagtgcgggtcggccaccacgcttttcagctcttctgagccgtataagtggtcgaagccatgcgacttcaggaacacatctttaccggcaaaacgcagattcgcgccctgcacgaaatagttctgataacccgagtttttcaggatatcgcccagacagatgttctgcgggaagaagctggagacagaggcggaggcgttgccttcaaagggggcaaacagcggtatgccgcactgagaagccaccatgcccgcaatcgtgtaatccgttcctggcagctgctgcgtgtggctgaaatccaggccttcatttttcaacgcgcccagttcaggcgtgagatccgggaaagcttcgttatcaaaataggtccgctcgagactttcgccgtagatataaaccaggttgagtttcgggtcagggatagttttcgacggctctttataataagccgcaaagtccgggtcgccatcgcgtgactgggatttcaccagttccgttatctgacgaaatgctgggctggcgtccaccgaacccagcgccagtaagagcgccagcaggctgtaaccaaaatggtgcggatgatggcgacgacggcgcaggatccagcccagcgcaccgaacaccgctgtcagccccagcacaatgccgatacccggcaggatgtatttgctgacgccagcaccggtcaggctgttggttaaggtatagagaaccgcgtcgttaataccatcgccagtaaaatagtcgctggcaaacagggtgatatttaaaacgacaaatagccccagcaccgttaatgtggctgcaaaccaccaggtgttacgtcccgctttccatgcgtaaatcagcacagaggcgagaaaaagggcgaaagagagtagttctgacaacgggcgatcctcactaaaccgggccgtttagccaacgtttaagctttttgagaagcacaatgtaatggcgtcgccatattgctgcaattctagtgtcaaaaaaatgcgatgttgttaggaattagtttataaacagacttttttgatcgcggtcgcttcccgtgtaacagggggaaaaccgtccaggagcagggaaaagggcaggagagagccgcgtcagccgggtaacagctaaaacgcggcgtttcgcggttcaggaaatgaagttcagcccctgctttaacaccagatcgcaggctttggttttcaccttttctgccagcggagtcgttccgatgttatccagattgagttgctgaccatctttggttttcagcaaaccctgaatgccatccagatagttggtgtcttctttttgctcttcactgttcaggcccagcttttccagcacctggttcttgatgttttcggcatcggttaccgacgccagcttttgcttcgcgcagtattgcagaatgcctgcggcgttgttcatgttatctgcgcttaaggcctggttcccgctgctaagcaagttagttaatgacgcgagcgaccaaccgccttcctgtgtcgtgctgttttggttgccaagttcgctggcggcgctggagagcgcatctttccaggacgcagcatgcaccccggtggaaattaatgcgctggcggcaatggcacagcacagaagatgtttaacagttttcatcatcattactcaaggtggaattgtgtcgcagtataccgccagaaacggggattaatactctttacctgttacccggctacggtagctatcccagttgaagatcacccacaaactgttacccaggcgcatacggtccatcacgcgttcgcccagcaacttggtcatctcttccatattactgttggtcagcatcccggttgggcgtttggaagaagagcggcgatcgacgatctggttgatgatcactttttcgtatttcgattcggtctgcacgccgatctcatcgatcaccagcagatcaacgttgctcagatcgttaagcagttgttcttcactggtaccgctattcctgaaggtatctttcatcgccgacataatatcggccacggtgatgatcaatacggatttaccgcgtagcagcagctcgttgcagattgccgccgccagatggtttttgccggttcctggcttaccagaaaagatgaagctggcgatgttgccgtcaaactcttcgacgtactggcgcgctttgcttaacgcattcatctgcccttcacactcaacgcgatagttctcaaaggagcagttctgatgcagtggccgaataccggagcggttaaaggtgcgctgcattttcatcgcccgattttcacgttcgagagcggcggagcggatcgctccttgttctttctgccaggccagtagttcttcacccgttttgaatgcaggtttgatatgggcaggcatcattttttgcaggcgttgcatcaggtcgccaacgtttttcatcgttaccctctgaatcctggtggaatttggctgtcaggttcactgaccgtattcacatctcgtttcggcagtccgccgttgctggcacgaccgatttgcaggctgcgcgccagtttttgttgccactgtacatggtgaaagactttaccttccgcctgccagtaggcaatgaatgaggtcagttcttcggtggtcaccggctctcttagtgccacgccccatagcgccgccaggcggataaagtcggcatcgggttgccagtccggatacatggcgaatttccccatgggtacagcaacgggagcagcttgcggttcctgatagagttgatcgtccagagcgacatcgcttcccggacgcgccagcttttcttccagcgccagcagttcagccaggcgtgcaggcgtgacggcataaaacgccggggcattgttagcaaatacggcaaccacaccgccttcagcttttgccagaacggtttggtgatcgtgtaccagggcgtcaataccaacgacgtccggggtcaaaactctggaagacatactgtttctcaaatatggaacgatgaacgagaagggagataacttttatagtaacacacggaggagaggtggctgtctctcatccgcgtgctttaagcgaggcaattttatacgcgagggcgcttgcggtacaaccataatccagggatggaaagaccgatggataacgcaccaacaatcgatgaagctgtaagaaaattggttaacagggtaatcatcaatgactcgctgtaacctaactggctgatttttacggccgaaatcattgcggtataagccgatatgccagggaacatagggataacagccgccacggtaaacactttcggatgtgccagataccagcgcgaccattgaataccaatggtgccgaccagcatagaagccataaaggttgaccactcaatattcagcccgctggtcattaagatcattcgtgaaccatgaccaatcgcgccaagcagcgcacaccagcgtaacgcccgaacgggaacgttgaacaccatcgcaaagccgaccgctggaatggcggcgaggatcatatcctgcgccaatgcaaacagaaattcgatcacacccatccgcgtagcccccaaatcgtcagtgccatcaccacgccgacgcaggtagccagtgtcagcagactggcgatcgcccagcgtgccagtccggtattgatgtggcctttaaacatatcggcgacggcattaatcaacggaaagcccggcaccagcagcagaacgctggcggccatcgcaatggtgggggtattgctgaaagtggggagttgcaaaagcaatccggaaatggtggtggcggcgaaagcggtaaggcaaaagttgatctgtggatgaagatgacgttgtgccagcagctggcggatatacatcgcggccgtactggcaaagaaggtgatgacggcaccatcccagccaccgttattgagtttacagaaacaggcgcaagaaaggccaaccattaaggctaccagccatcttgggtaacgtaatggctgaatttggctaaatcgtttctctacgcctttgtaatccagcagatggtgctccgccagaatcacaatgtgctggacttcagtcaccacatgcatattaatgccgcgatcgtgatttttacgtgtcgatgtcaggcattgcccatctttaatggttgtcagcactatggcgttcgaagagatagaactttcaacgctgtccattcccagcgcccgacccagtcgtgaggaaagctcatcaaccaacgcgctttccgcaccatgttgcaaaagaaataatccacactggatacaaagccgcgttacggctcgctgttgctcagtttgcataactcgccctttgtcatagacgtgctgcgtattgttcagataatgagaatccatttgtatcatgaagcacggttgttttgcggtaggttaagatcaaaattgcgctgattaatcctggttatcgggagaagctcggtgataaaaagcgaattatctctcgccgcaaacaaactatcacatgaatattatcatcataatgaatttattgtttggcctttacgaatcaggataatagataaccgggcacgttttttaatgttaacaagttaaaaccatcagatttcattgaataaatattggttgtgtgatttttcattctgcaggaagggatatcatttaattataaattaaatgaatgtgatttctgtttttcattaagtattcctaacaacttaatgtagatattttaaatgtctccaggctatttcaccaggttatcatttgatgctaaccttctgacacatgcagtggagttgttgtgcagcaggagtatgctgatatgaaagtgaatgctaaggataatttattcgcttaatctattaatttgctggaaacatttaaggaatgaatatcctgaataaaccatcataatttttagacagtggatgtggaggaaatatgttgccaggatgctgcaaaaatggaattgttatcagtaaaatacctgttatgcaagcagggctaaaagaggtcatgaggactcacttccctgaatatgaaataatatccagcgcctctgcggaggaccttaccttattacaattacgtcgttccggattagtcattgctgatttagccggtgaaagtgaagatccacgttctgtttgtgaacattattattctttaatctcacaatatcgggaaattcactgggttttcatggtgtcacgctcctggtattcccaggcagtagaattgctcatgtgccctacggcgacgttattgtctgatgttgaacccattgagaatctggtcaagaccgtacgttccggcaatacgcacgcagagcgtatcagcgccatgctgacctctccggcaatgactgaaactcatgattttagctatcgctccgtcattctcactctttcagagcgcaaggtactgcggctattaggtaaaggatggggcatcaaccagatagcttcgttgcttaagaaaagtaataaaactatcagcgcccaaaaaaacagtgcgatgcgtcgactggcaattcacagcaacgctgaaatgtatgcatggataaatagcgcgcagggtgcaagagaacttaacttgccttctgtttatggagatgccgcagaatggaacacagccgaattaagaagagaaatgtcgcactcatagaaaaatgcgtcatgagcagtatcggtattgagagtttattcagaaagtttgcgggtaacccttataagctccatacctataccagtcaggagtcatttcaggatgccatgtcgcggatctcatttgcggcggtcattttttctttttctgccatgagaagtgagcgcagagagggattatcttgcctgactgaactggcgattaagtttccgcgtacccggcgtttagttattgcggatgatgatattgaagctcggctgattggttcattgtcgccatcaccgctggacggtgtattaagtaaagcgtcaacgctggagatttttcatcaggaactctttttgtcattaaatggtgtacgtcaggcgaccgaccgactgaacaatcagtggtacattaaccaaagccggacgctaagcccgacggagagagaaatattgcgctttatgtcgcgtggctactcaatgacacaaattgccgagcagcttaaacgcaatatcaaaacgatccgtgcacataaatttaatgtgatgtcgaaactgggcgtaagttctgacgcagggttgttggaggccgcagatattctgttatgtatgcggcattgcgaaacaagtaatgtgttgcatccctattaatccgcatgatgccgggtttacttccccggcagtgctttcatttcagcgtacaatcgccacattgctgcacatccggtaagcgataacgctggcagcaagtgcggcgcaccagcaggccgtggcgcagtaccacggtacgccagagtggattatcttcaccgttcgtgagcgttttctcaaaaaagagggcatggcgcagcgattcaaccgtcgcctcgccgagcagttgcttcatctcagtgagataccagttgatcaaataaccggtattactccagataagtttgccgttgatctctccggtcgcttctagtgcctgcacaaccggaaccagcgcctggctgattaacctttccattcgctgctgcggcgaatgtggtgttgcgtttttatcttcacacacatcgacccagaaacaggcggcacggccggtttcgtgaaactcagcatggaaatgttccggcgacacatctaatgccttttcctgcgtcagtagcgccagcattaatggtggcaccatcaggccgatataccattgtgcccatagtgagatcagcggtttgttctcgcggatcatcgttggttggttgcgatagatatgatcggaatagaccgcgagtagagaacttagcgcattcggtgatgaccattgcgccagcgtcatggcgttaagcggagcgggttcatccaggcggataaactccagcaaatgttcacgatgttcggcgatcgtcgcacgtacggcttgtgcaagcccagcatcctgtggctggagatgcgttcgccagataacatcttcatagagcggtgcggaacgataggccataatcgggatagtaatctaaatgataatgattgctaatcctagcgataggtttacccgatagcaagggatttctctggcttgcaaatgataaaaattatcatatgatattggttatcattatcaatgaaagagatgaaaccatgttgcaacgtacgctgggcagtggctggggagtgttgctgccaggattgctgattgcagggctgatgtatgcggatttatcaccggatcagtggcggattgtcattctgatgggattagtattgacgtcggtgatgctgtatcacaaacagttacggcattacgttttgctaccatcgtgcctggcgcttattgctgccatcatgctgatgataatgaatttgaatcagggatgaaaaatcaaggaagaaacaagaaaggaagtaaagataattggtgcgaggggggggacttgaacccccacgtccgtaaggacactaacacctgaagctagcgcgtctaccaattccgccaccttcgcacagtcatcttactttttttgatatcgcctcgtttggtgcgaggggggggacttgaacccccacgtccgtaagaacactaacacctgaagctagcgcgtctaccaattccgccaccttcgcccagtgcgagcaatatcaacgtggtttttggtgcgaggggggggacttgaacccccacgtccgtaaggacactaacacctgaagctagcgcgtctaccaattccgccaccttcgcataccatcaattcttaaaaagaattgctaccacggaggcgcattctagtggttttcagcttttcgtcaatagttaattatcgccggaggtgtaattgctggaaaaatgtccatcaggaaactagcgtgcaggtttggtaggcatgcgggggcagatgccagatgcgacgctggcgcgtcttatctggcctacgaagggctaacgtgcaggttttgtaggtcggataaggcgttcacgccgcatccgacacggtattcggcgagataattaacctttcttcgcctggcgggtcataatggcgcgatacaccttgaaacgcccggtttgcgcaatcacttcatggaagccaaatgtctcatccagcacgtccgggtaaggcaggaaggcgttcgctacaattcgcagctcgccgccgctattaagatgacgcaccgcgccgcgaatcagcgtttgcgccgcatccaggctggtttgcatcccatcgtggaacggcgggttggagatgatcatatcaaaacgacctttcacctcggaaaagacgttgctggcaaagacttcaccttcaacacagttggccgcaagtgttgcgcggctggcttctaccgctggcgcagagacatcgcacaaggtgagacgaattttcggcgaatggcgcgcaaaggcaactgaaagcacccccgcgccacagccgacatccagcactttacctttcgtgtgcggagttaacgtcgagagcagcaactggctaccgacatccagaccgtcgcggctaaacacgccaggcagcgttttgaccgtcaggccatcgacgctgtattcgccccagaatttatcggcatcaaataccggctgtttttccagacgaccaaaatagaggccacagcgacgagcgctgtcgactttattcaacggcgcataatctgccagcatctgctcggcgctgcgcacgccgctgcggttctcgccaacgacaaaaatatccgtccccaccggcagcagagaaagtaaattcatcaactggaactgggcttccggtttgttcttcggccagtagtaaatcagcgtatcgcaatctgcgacgtcatccgccgtggcgaccagactgaaacgggcgttatcccccatctggcggcttaatacctgccagtggtggaattgctgggtatgagcacggctggccgcggtatctaaacgcgcgggcaggtcatcctgtaagtctccggcaaacagaatacggctttgttcgaaatcatcactgtgacgcagcaagacttcacttgccggggtaaatgcagacatggaatgctcctcaattgatactggcggcgattatagccatatgttggcgcggtatcgacgaatttgctatatttgcgcccctgacaacaggagcgattcgctatgacatcccgacgagactggcagttacagcaactgggcattacccagtggtcgctgcgtcgccctggcgcgttgcagggggagattgccattgcgatcccggcacacgtccgtctggtgatggtggcaaacgatcttcccgccctgactgatcctttagtgagcgatgttctgcgcgcattaaccgtcagccccgaccaggtgctgcaactgacgccagaaaaaatcgcgatgctgccgcaaggcagtcgctgcaacagctggcggttgggtactgacgaaccgctatcactggaaggcgctcaggtggcatcaccggcgctcaccgatttacgggcaaacccaacggcacgcgccgcgttatggcaacaaatttgcacatatgaacacgatttcttccctcgaaacgactgatttaccggcggcttaccacattgaacaacgcgcccacgcctttccgtggagtgaaaaaacctttgccagcaaccagggcgagcgttatctcaactttcagttaacgcaaaacggcaaaatggcggcgtttgcgattacgcaagtggtgctggatgaagctacattgttcaatattgcggtcgatcctgactatcagcgtcagggattgggaagggcgctgctggaacatctgatcgacgaactggaaaaacgcggcgtggcgacactatggctggaagtccgtgcttcaaacgctgccgccattgccctgtacgaaagtttaggctttaacgaggcgacgattcgccgcaattactaccccaccacggacggtcgcgaagacgccatcatcatggcgttgccaatcagtatgtaagacaaggtggaataatgaagtgggactggattttctttgatgccgatgaaacgctgtttacctttgactcattcaccggcctgcagcggatgtttcttgattacagcgtcacctttaccgctgaagattttcaggactatcaggccgttaacaagccactgtgggtggattatcaaaacggcgcgatcacttcattacagcttcagcacgggcggtttgagagctgggccgaacggctgaaagttgaagcaggcttgcttaacgatgcctttattaatgcgatggcggaaatctgtacgccgttgccgggcgcggtttctctgcttaacgccattcgtggcaacgctaaaatcggcatcatcaccaacggttttagcgccttgcagcaagtgcgtctggaacggacgggcctgcgtgattacttcgatttgctggtgatttccgaagaagttggcgttgccaaaccgaataagaaaattttcgattatgcgctggaacaggcgggcaatcctgaccgttcacgcgtgctgatggttggcgacactgccgagtccgatattctcggtggcatcaacgccgggcttgcgacctgctggctgaatgcacaccatcgcgagcaaccagaaggcatcgcgcccacctggaccgtttcttcgttgcatgaactggagcagctcctgtgtaaacactgattgcctcccccccgttgatgggtaaaatagccgcaatttttcgttttcaacaagcgcggcgcgatgccgcttactcaagaagaaagaattatgacgttgtctccttatttgcaagaggtggcgaagcgccgcacttttgccattatttctcacccggacgccggtaagactaccatcaccgagaaggtgctgctgttcggacaggccattcagaccgccggtacagtaaaaggccgtggttccaaccagcacgctaagtcggactggatggagatggaaaagcagcgtgggatctccattactacgtctgtgatgcagtttccgtatcacgattgcctggttaacctgctcgacaccccggggcacgaagacttctcggaagatacctatcgtaccctgacggcggtggactgctgcctgatggttatcgacgctgcaaaaggtgttgaagatcgtacccgtaagctgatggaagttacccgtctgcgcgacacgccgatcctcacctttatgaacaaacttgaccgtgatatccgcgacccgatggaactgctcgatgaagttgagaacgagctgaaaatcggctgcgcaccgatcacctggccgattggctgcggcaagctgtttaaaggcgtttaccacctttataaagacgaaacctatctctatcagagcggtaaaggccacacgattcaggaagtccgtattgttaaagggctgaataacccggatctcgacgctgcggttggtgaagatctggcacagcagctacgtgacgaactggaactggtgaaaggcgcgtctaacgagttcgacaaagaattgttccttgcgggcgaaatcactccggtattcttcggtactgcgctgggtaacttcggcgttgatcatatgctggatggcctggtggagtgggctcctgcgccgatgccgcgtcagactgatacccgtaccgtagaggcgagcgaagacaaatttaccggcttcgtatttaaaattcaggccaacatggacccgaaacaccgcgaccgcgtggcgtttatgcgcgtagtatccggtaaatatgaaaaaggcatgaagctgcgccaggtgcgtactgcgaaagatgtggttatctccgacgcgctgacctttatggcgggcgaccgttcgcacgttgaagaagcgtatccgggcgatatcctcggcctgcacaaccacggcactattcagatcggcgacacctttacccagggtgagatgatgaagttcaccggtattccgaacttcgcaccagaactgttccgtcgtatccgcctgaaagatccgctgaagcaaaaacagctgctcaaagggctggtacagctttccgaagagggcgcggtgcaggtgttccgtccgatctccaacaacgatttgatcgttggtgctgttggtgtgctgcagtttgatgtggtggtatcgcgcctgaagagcgaatacaacgttgaagcagtatatgaatcagtcaacgttgccactgcccgctgggtagaatgtgcggacgcgaagaaattcgaagagttcaagcgtaagaacgaaagccaactggcgcttgatggcggcgataacctcgcttacatcgctaccagcatggtcaacctgcgcctggcgcaggaacgttatccggacgttcagttccaccagacccgcgagcattaattcttgcctccagggcgcggtagccgctgcgccctgtcaatttcccttccttattagccgcttacggaatgttcttaaaacattcacttttgcttatgttttcgctgatatcacgagcggtttcaaaattgtgatctatatttaacaaagtaatgacatttctgacggcgttaaataccgttcaatgcgtagatatcagtatctaaagccgtcgattgtcattctaccgatattaataactgattcagaggctgtaatggtcgttattcatcacccatcgcttttgtgatggcgaccattgacttctgtagagggtgaagtctctccctattcagcaatgcaacctcgtgttgccaggctcaaattacgagcaaacatacaggaataaatcgatgactatgacaagactgaagatttcgaaaactctgctggctgtaatgttgacctctgccgtcgcgaccggctctgcctacgcggaaaacaacgcacagactaccaatgaaagcgcagggcaaaaagtcgatagctctatgaataaagtcggtaatttcatggatgacagcgccatcaccgcgaaagtgaaggcggcgctggtggatcatgacaacatcaagagcaccgatatctctgtcaaaaccgatcaaaaagtcgtgaccctgagcggtttcgttgaaagccaggctcaggccgaagaggcagtgaaagtggcgaaaggcgttgaaggggtgacctctgtcagcgacaaactgcacgttcgcgacgctaaagaaggctctgtgaagggctacgcgggtgacaccgccaccaccagtgaaatcaaagccaaactgctggcggacgatatcgtcccttcccgtcatgtgaaagttgaaaccaccgacggcgtggttcagctctccggtaccgtcgattcccaggcacagagcgaccgtgctgaaagtatcgccaaagcggtagatggtgtgaaaagcgttaaaaatgatctgaaaactaagtaattcgtcgtaattcgtcctcccgaactttgtcgggaggcgcgatgtgcaccacactaaaaatatcgcattgagtgattttcacgctcatatcaagcggtgacattaactatggtaaaggagacgcttatgtttcgttggggcatcatatttctggttatcgcgttaatcgccgccgcacttgggtttggtggtctggccggtaccgctgcaggcgcagctaaaattgtctttgtcgtcgggattattctgttcctggtgagtttgttcatgggccgaaaacgaccctagatttcagaccattaagaaaattttatccaaagccagtccagcggactggcttttgcggttttagcgaataataaattgcgttactttgtcattctttcacaacaaaaacaggaaggcagaggtggggcagcgaatacctgtaacgcttggtaatattgcgccgttgtcgctaaggccgttccagcctggacgaatagctctggtgtgcgaaggcggcggacagcgtggaattttcacggctggcgtgctggatgagtttatgcgcgcgcagtttaatcctttcgatctttatctcggcacatctgccggggcgcagaacctctcggcgtatatctgcaatcagcccggttacgcgcgcaaagtcatcatgcgctataccacaaaacgcgaatttttcgatccattgcgctttgtccgtggaggaaatcttattgatctcgactggctggtggaggccaccgcaagtcagatgccgttgcaaatggataccgccgcgcggttgtttgacagcggcaaatcgttttatatgtgcgcctgtcgtcaggatgactacgcgccgaattactttttaccaaccaaacaaaactggctggatgtgattcgcgcctccagtgcgatacctggcttttatcgtagcggagtgtcgctggaaggcattaactacttggatggcgggatcagtgatgcgattccggttaaagaggcggcaaggcagggcgctaaaacgttggtcgtcatccgcactgtgccgtcacaaatgtactacacgccgcagtggttcaaacgcatggaacgctggctgggtgacagtagcctgcagccgctggtcaatctggtgcagcatcatgaaaccagctatcgtgacattcagcaatttattgagaaaccaccgggcaagctgcggatattcgaaatttatccaccgaagccattacatagtatcgcgcttggcagtcggattccggcgctgcgtgaagactataaacttgggcgtttatgcggtcgttatttcctcgccacggttggcaagctattaactgaaaaagcgccgcttacccgccatctggtgccagtggtgacgccggaatcgatcgttattccgcctgcgccagtcgccaacgatacgctggttgccgaagtgagcgatgctccgcaggcgaacgacccgacatttaacaatgaggatctggcttgatttgccgttttatcgatacccactgccattttgatttcccgccgtttagtggcgatgaagaggccagcctgcaacgcgcggcacaagcgggcgtaggcaagatcattgttccggcgacagaggcggaaaattttgccagcgtgcaggcgttagcggaaaaatatcaaccgctgtatgccgcattggggttgcatccggggatgttggaaaaacatagcgatgtgtctcttgatcagctacagcaggcgctggaaaggcgtccggcgaaggtggtggcggtgggggagatcggtctggatctcttcggcgacgatccgcaatttgagaggcagcagtggttactcgacgaacagctgaaactggcgaaacgctacgatctgccggtgatcctgcattcacggcgcacacacgacaaactggcgatgcatcttaaacgccacgatttatcgcgcactggcgtggttcacggtttttccggcagcctgcaacaggccgagcggtttgtacagctgggctacaaaatcggcgtaggcggtactatcacctatccacgcgccagtaaaacccgcgatgtcatcgcaaaattaccgctggcatcgttgttgctggaaaccgacgcgccggatatgccgctcaacggctttcaggggaagcctaaccgcccggaacaggctgcgcgggtgtttgacgtgctttgcgagttacgtccggaaccagaagatgagattgccgaagtgttgcttaataatacgtatgcggtgtttagcgttcgtgggtagtttacccttcgtaggcagcatccggcagttggcgcacaatgcctgatgcgacgcttgtcgcgtcttatcatgcctacaagtttgtgccgaaccgtaggccgtatccggcatgtcacaaatacagcgccgggaatattaagcggctcaccccgcgcacctttaatgcatcagccaacggctcaacgtcttccggcgtggcgctcgcccagctttgcgcctcgccatacacgccgtgggcatgaaacgcgttcaggcgtaccggaacatcgccaagtcccttgataaacaccgccagttcttcgatgtgttgcaaataatccacctggccagggattaccagcaaacgcagttccgccagcttaccgcgctctgccagcaaacagatgctgcgcttaatctgctgattatcgcgtccggttatttgttgatgacattcgctaccccatgctttgagatcgagcattgcgccgtcgcacaccgggagcaatttttcccagccggtctcgctcaacataccgttactgtccaccagacaggtgagatggcgcagttgcggatcatttttgatagcagtaaacagcgccaccacaaacggcagctgggtcgtggcttcgccgccactcaccgttatcccttcgataaacagcaccgctttgcggacatggctaagcacttcgtccacgctcatggattgcgccatcggcgtggcatgttgcggacacctcttcaggcaggtatcacattgctcgcagaccacagcgttccacaccactttgccgtcaacaatctgcaacgcctgatgcggacactgtggcacgcactccccacagtcattgcaacgtcccatcgtccacggattgtgacagtttttgcagcgcagattgcagccctgcaaaaacagagccagacgactgcctggcccgtcaacgcaggagaaggggataatcttactgactaaagcgcatctgctgttcatggcttatcacgcgcggctggcgttccagaatacgagtgttgcgtgcggcttcttcgcccagccaggtggtgttggtgcgtgaaccttcggcgcgatatttttctaaatccgacaaacgcaccatataaccggtaacgcgaaccagatcgttaccgctgacattggcggtaaattcacgcattccggctttaaaggcaccgaggcaaagctgtaccagtgcctgcgggttacgtttgatggtttcgtcgagggtcagaatgtcgctgatgccggaataataataagcatgatgcggggcgacagtttgcagatgggtgatcggatctggctcatcgccatacggcaaacgcgcgcccggcgtggtgccgatatcggaactgatccccgactgtgcgtgtaacatggcgcgtttttgccagccatatttcacgggggtattggcgacaaactccgccagttgcgcgctgatgcgataacccacttcatttgcggcggcttctttaccgtaacgtgcggcaatcccttctttctcacacagcaagttaaccgcttccgccagcccatacatgccaaacattggcacaaaacgttcagggttaatcagcccttctttcaccaggaagctattctcaaagaagtgtgattgttgatagaggaattcacaccgcgcatcgatgatggcgatctgctgctggcagtagtgcggtagagtgcgcgtaaagaagtcatccagcgattcgctgcgctcggcaatggctttcaggttaaggcgtaccagcgtgctgccaccacccgccagcggcagtgagttgtaacagctcacaatcccgtagcccccttttgtgaaaattttatcatgcaccggaccgttggcgatgtgcggtttgctacattcacagatgttcttcgccacttccagcagcaggtcatcaggggtgatttcaggatcgtagataaaggtcaggttcggtgaaacctgcttcaactctgcgtctgcacgtaagatcgcgcgggtaatgggcgaatcagacgggccgatattggcgtgcataaaggcgtctggcagggttctgtcgaggtaacgccagaaacgttttattcgaacatcgatctcgtcttgtgttagaattctaacatacggttgcaacaacgcatccagttgccccaggtagaccggcatcgatgtgaccgacggtacgtggtggtaaagaatggtcagcagagagagtgcgtcatcaagatctttcgcgccttccagctccagccattcggaaccgttcgccagaaaacgggcgtaatcgggtaagacatagcgcggtttgtacggcgcatgaccttcaaacatatcgcagattacaccctcatccagcgcgcggcgggcttcggcaggaagctgcggataaggcagattgttttctgcttccagagccagaaaatggcgcttctgctccgggctaagcactgggctggtgacaatttgctggcaacgttgttgcagtgcattttcatgagaagtgggcatcttcttttccttttatgccgaaggtgatgcgccattgtaagaagtttcgtgatgttcactttgatcctgatgcgtttgccaccactgacgcattcatttgaaagtgaattatttgaaccagatcgcattacagtgatgcaaacttgtaagtagatttccttaattgtgatgtatatcgaagtgtgttgcggagtagatgttagaatactaacaaactcgcaaggtgaattttattggcgacaagccaggagaatgaaatgactgatctgaaagcaagcagcctgcgtgcactgaaattgatggacctgaccaccctgaatgacgacgacaccgacgagaaagtaattgctctgtgtcatcaggccaaaactccggtcggcaataccgccgctatctgtatctatcctcgctttatcccgattgctcgcaaaacgctgaaagagcagggcaccccggaaatccgaatcgctacggtaaccaacttcccacacggtaacgatgacatcgaaatcgcgctggcagaaacccgtgcggcaatcgcctacggtgctgatgaagttgacgttgtgttcccgtaccgcgcgctgatggcgggtaacgagcaggttggttttgacctggtgaaagcctgtaaagaggcttgcgcggcagcgaatgtactgctgaaagtgatcatcgaaaccggcgaactgaaagacgaagcgctgatccgtaaagcgtctgaaatctccatcaaagcgggtgcggacttcatcaaaacctctaccggtaaagtggctgtgaacgcgacgccggaaagcgcgcgcatcatgatggaagtgatccgtgatatgggcgtagaaaaaaccgttggtttcaaaccagcgggcggcgtgcgtactgcggaagatgcgcagaaatatctcgccatcgcagatgaactgttcggtgctgactgggcagatgcgcgtcactaccgctttggtgcttccagcctgctggcaagcctgttgaaagcgctgggccacggtgacggtaagagcgccagcagctactaagtaagatgctttacgcctgatgcgctgcgcttatcaggcctacgagacgtatctacccgtaggccggataaggcgtagacgcatccggcaaaagccgcctcatactcttttcctcgggaggttaccttgtttctcgcacaagaaattattcgtaaaaaacgtgatggtcatgcgctaagcgatgaagaaattcgtttctttatcaacggtattcgcgacaacactatctccgaagggcagattgccgccctcgcgatgaccattttcttccacgatatgacaatgcctgagcgtgtctcgctgaccatggcgatgcgagattcaggaaccgttctcgactggaaaagcctgcatctgaatggcccgattgttgataaacactccaccggcggcgtcggcgatgtgacttcgctgatgttggggccgatggtcgcagcctgcggcggctatattccgatgatctccggtcgcggcctcggtcatactggcggtacgctcgacaaactggaatccatccctggcttcgacattttcccggatgacaaccgtttccgcgaaattattaaagacgtcggcgtagcgattatcggccagaccagctcactggctccggcggataaacgtttctacgcgacccgtgatattaccgcaaccgtggactccatcccgctgatcactgcctcgatcctggcgaagaaactggcggaaggtctggatgcgctggtgatggacgtgaaagtgggtagcggcgcgtttatgccgacctacgaactctctgaagcccttgccgaagcgattgttggcgtggctaacggcgctggcgtgcgcaccaccgcgctgctcaccgatatgaatcaggtactggcctccagtgcaggtaacgcggttgaagttcgtgaagcggtgcagttcctgacgggtgaatatcgtaacccgcgtctgtttgatgtcacgatggcgctgtgcgtggagatgcttatctccggcaaactggcgaaagatgacgccgaagcgcgcgcgaaattgcaagcagtgctggacaacggtaaagcggcagaagtctttggtcgtatggtagcggcacaaaaaggcccaaccgacttcgttgagaactacgcgaagtatctgccgacagcgatgctgacgaaagcagtctatgctgataccgaaggttttgtcagtgaaatggatacccgcgcgctggggatggcagtggttgcaatgggcggcggtcgtcgtcaggcatctgacaccattgattacagcgtcggctttactgatatggcgcgtttgggcgaccaggtagacggtcagcgtccgctggctgttatccacgcgaaagacgaaaacagctggcaggacgcggcgaaagcggtgaaagcggcaattaaacttgccgataaagcaccggaaagcacaccaactgtctatcgccgtatcagcgaataacggtatactgatctgatcatttaaatttgaagcactgagtacggagaacatatgaaacgtgcatttattatggtgctggactcattcggcatcggcgctacagaagatgcagaacgctttggtgacgtcggggctgacaccctgggtcatatcgcagaagcctgtgccaaaggcgaagctgataacggtcgtaaaggcccgctcaatctgccaaatctgacccgtctggggctggcgaaagcacatgaaggttctaccggtttcattccggcaggaatggacggcaacgctgaagttatcggcgcgtacgcatgggcgcacgaaatgtcatccggtaaagataccccgtctggtcactgggaaatcgccggtgtcccggttctgtttgagtggggatacttctccgatcacgaaaacagcttcccgcaagagctgctggataaactggttgaacgcgctaacctgcctggttatctcggtaactgccactcttccggtacggtcattctggatcagctgggcgaagagcacatgaaaaccggcaagccgattttctatacctccgctgactccgtgttccagattgcctgccacgaagaaacctttggcttggataaactctacgaactgtgcgaaatcgcccgtgaagagctgaccaacggcggctacaacatcggtcgtgttatcgctcgtccgtttattggcgacaaagccggtaacttccagcgtaccggtaaccgtcacgacctggctgttgagccgccagcaccgaccgtgctgcagaaactggttgatgaaaaacacggtcaggtggtttctgtcggtaaaattgcagacatctacgccaactgcggtatcaccaagaaagtgaaagcaactggcctggacgcgctgtttgacgccaccatcaaagagatgaaagaagcgggtgataacaccatcgtcttcaccaacttcgttgacttcgactcttcctggggccaccgtcgcgacgtcgccggttatgctgcgggtctggagctgttcgaccgccgtctgccggagctgatgtctttgctgcgcgatgacgacatcctgatcctcactgctgaccacggttgtgatccgacctggaccggtactgaccacacgcgtgaacacattccggtactggtttacggcccgaaagtaaaaccgggttcactgggtcaccgtgaaaccttcgcggatatcggccagactctggcaaaatattttggtacttctgatatggaatatggcaaagccatgttctgataatgggtgcggcttgatgccctcaccccggccctctcccacagggagagggtgaaaacatgttgataaggataaaacaatggctaccccacacattaatgcagaaatgggcgatttcgctgacgtagttttgatgccaggcgacccgctgcgtgcgaagtatattgctgaaactttccttgaagatgcccgtgaagtgaacaacgttcgcggtatgctgggcttcaccggtacttacaaaggccgcaaaatttccgtaatgggtcacggtatgggtatcccgtcctgctccatctacaccaaagaactgatcaccgatttcggcgtgaagaaaattatccgcgtgggttcctgtggcgcagttctgccgcacgtaaaactgcgcgacgtcgttatcggtatgggtgcctgcaccgattccaaagttaaccgcatccgttttaaagatcatgactttgccgctatcgctgactttgacatggtgcgtaacgcggtagacgcggctaaagcactgggcattgatgctcgcgttggtaacctgttctccgctgacctgttctactctccggacggcgaaatgttcgacgtgatggaaaaatacggcatcctcggcgtggaaatggaagcggctggtatctacggcgtcgctgcagaatttggcgcgaaagccctgaccatctgtaccgtgtctgaccacatccgcactcacgagcagaccactgccgctgagcgtcagaccaccttcaacgacatgatcaaaatcgcactggaatccgttctgctgggcgataaagagtaattgtgtttcgctgaaaggcgattgtcgtgtgaagccggagtgggagactgctccggctttttagtatctattcatcaatagcaactgatttatagatttactattatttttcatatggatagaaaataaaatctattcaagtatctattcacgaatctattcatttatgttcagccgtcatccaggaagggcatatcagcaactctggtggacaaccataaatttctgccattttgcttttgatgtttgagctaaaccgttccgtcttttcgatctattttagagaattaatcgagatacctaacattttacttacttcagcaagcgataatttatgcctgatacgcacggcggctagccaggaaatacgctggcttaacattaaattgataatctcccgctcctggttttccagatcgatcatattcccttcctttggtattttaatcagcgagttaccttaccgcccccgctatccacgtcgacaactcccgtagctctttttcctggtccgggaagtcaaccaacagcgcttcgcactcttgttgcagcatatccgcgcggtacaggcagccttgcagtcgcccggcgagggcttccagcggcgcggggttgaggctgtcggtaaacacctgggcgcgggtgatatggcctttttcaacgtcgaaatgcagttccacgccgccccagctaaagcgttcatccagcagatgcgagaatgccggagcctgaccgaagttccattcccagctactctgacgggcaaaggtttcggcgaagtttggcaagtctggcgttttgtccggggagatgatttccgcttctacacgctcgccataatgggcgaaaaaggccttggttatggcctcgcaaacctgctcatgggtgatccccggcagcagctcggtgaggttggtcacgcgggaacgcactgaggtaatgcctttcgccgccagtttctttttatccggattgagatagtttgccaggcggctaaggtcggcattgagcagcaaggtgccgtggtggaagccacgatctttggtttcgcgataggccgatcctgagactttgcggtcaccttcggcggttttcaccaccagatcgttacgcccggacgcttcggcgctgacgccaagcgcgttcagcgcattgagcacaatcgacgtggagatggttttatcgtactccggcttgccagccataaaggtaaagcaggtattgccgagatcgtggaacaccgcgccgccaccgctactgcgccgtgccaggcggacgttatcttcttccatccgccgggtattacactctttccacgggttctgcgcgcgaccaatcactaccgtgtcggcattgcgccagagaaacagaacgcgctgcgtggcgggcatctggcgaaaaatacactcctccaccgccaggttaaaccacgggtcgtaagagtcagagatgagcaggcgtaatgtggacataacgatttcctttcttgtagtaatgggtcactcttttttctcgctttcttcctcttccggcaccggtttgctggcggttaacaggaagggcgattgctgccagcgggtacgtttaccctgtagcagcgtgcgggtcagcactacgccgattgccagtgaaagcagcaacatcaggcgtaaaatgttagtggtgttatccacctgttgggcttcggtggcgagcgtatgggtgtcgagcgtcaggcgcagatagccgagcggtccgtttttcccggcaattggttcgacaatctgctggttaaaatagccgcccgcttttttaccgtcgagcgccagccggtcgcgcacttcgacgctttcgcctgaacgggcgataagatcgccttgttcgtcatacacacccgcgtcgaggatgcggctttcatccgttaactgatcgaggatcgcctgaatgcgtttttcatctggtgagtcggtacgcatcagcggtgcaacgttcagcgtcacctgacgcgccagggtgcgggccagttcttccagctgtggattacgctgtcgctggtggttttgactaaaccatgacgccccctgcatcagtgccactaacaaggcaagacagaacaggacaatcactgcccgatgcagccggaatttcagttttgtgcgagccatcttccaccctttgaaaatttgagacttaatgttgccagaagcaatggatacaaggtagcctcatgcgttattttccctgcttcgaacgattttacaggagccttaatgcctaacattacctggtgcgacctgcctgaagatgtctctttatggccgggtctgcctctttcattaagtggtgatgaagtgatgccactggattaccacgcaggtcgtagcggctggctgctgtatggtcgtgggctggataaacagcgtctgacccaataccagagcaaactgggtgcggcgatggtgattgttgccgcctggtgcgtggaagattatcaggtgattcgtctggcaggttcactcaccgcacgggctacgcgcctggcccatgaagcgcaactggatgtcgccccgctggggaaaatcccgcacctgcgcacgccgggtttgctggtgatggacatggattccaccgccatccagattgaatgtattgatgaaattgccaaactggccggaacgggcgagatggtggcggaagtaaccgaacgggcgatgcgcggcgaactcgattttaccgccagcctgcgcagccgtgtggcgacgctgaaaggcgctgacgccaatattctgcaacaggtgcgtgaaaatctgccgctgatgccaggcttaacgcaactggtgctcaagctggaaacgctgggctggaaagtggcgattgcctccggcggctttactttctttgctgaatatctgcgcgacaagctgcgcctgaccgccgtggtagccaatgaactggagatcatggacggtaaatttaccggcaatgtgatcggcgacatcgtagacgcgcagtacaaagcgaaaactttgactcgcctcgcgcaggagtatgaaatcccgctggcgcagaccgtggcgattggcgatggagctaatgacctgccgatgatcaaagcagcagggctggggattgcttaccatgccaagccaaaagtgaatgaaaaggcggaagtcaccatccgtcacgctgacctgatgggggtattctgcatcctctctggcagcctgaatcagaagtaattgctcgcccgccatcctgcgggcggcacagcattaacgaggtacaccgtggcaaaagctccaaaacgcgcctttgtttgtaatgaatgcggggccgattatccgcgctggcaggggcagtgcagtgcctgtcatgcctggaacaccatcaccgaggtgcgtcttgctgcgtcgccaacggtggcgcgtaacgagcgtctcagcggctatgccggtagcgccggggtggcaaaagtccagaaactctccgatatcagccttgaagagctgccgcgtttttccaccggatttaaagagttcgaccgcgtactaggcggcggcgtggtgccaggaagcgccattctgattggcggtaacccaggtgcggggaaatccacgctgctactgcaaacgctgtgcaaactggcccagcagatgaaaacgctgtatgtcactggcgaagagtcgctgcaacaggtggcaatgcgcgctcatcgccttggcctgccgactgacaatctcaatatgttgtcggaaaccagcatcgaacagatctgcctgattgccgaagaagagcaaccgaaactgatggtaattgactcgatccaggtgatgcatatggcggatgtacaatcatcgcctggtagcgtggcgcaggtgcgtgaaacggcggcttatctgacgcgcttcgccaaaacgcgcggtgtggcgattgtcatggttgggcacgtaaccaaagatggctcgctggctggccctaaagtgctggaacactgtatcgactgttcggtgcttctggatggtgatgccgactcccgttttcgcaccttgcgcagccataaaaaccgcttcggcgcggtgaatgagctgggcgtcttcgcgatgaccgaacaggggctgcgtgaagtcagcaacccttcggcaattttcttaagtcgcggagatgaagtgacctccggcagctccgtgatggtggtgtgggaaggaacgcgtccgttgctggtggagattcaggcgctggtcgatcactcgatgatggcgaatccgcgccgcgtggcagtggggctggaacaaaaccgtctggcaatcctgctggctgtcttgcaccgtcacggtggtctgcaaatggccgatcaggatgtatttgtgaacgtggtcggcggcgtgaaggtaaccgaaaccagtgccgatttagcgttactgctggcgatggtttccagcctgcgtgacagaccgctgccacaggatctggtggtgtttggtgaagtcgggctggcaggggagatccgcccggtgcccagcggtcaggaacgaatttcagaagcggcgaaacacggttttcgccgggcgattgttccggcggctaacgtaccgaaaaaagcgccggaagggatgcagatttttggcgttaaaaaactctccgacgcgcttagcgtgttcgacgacttataatgagagatacggagggagatatgtcgtcatttgattacctgaaaactgccatcaagcaacagggctgcacgctacagcaggtagctgatgccagcggtatgaccaaagggtatttaagccagttactgaatgccaaaattaaaagccccagcgcgcaaaagctggaggcgttgcaccgttttttggggcttgaatttccccgacagaagaaaaccattggtgtcgtattcggtaagttctacccgctgcataccggacatatctaccttatccagcgcgcctgtagccaggttgacgagctgcatatcattatgggttttgacgatacccgcgaccgcgcgttgtttgaagacagcgccatgtcgcagcagcccacggtgccggatcgtctgcgctggttattacaaacttttaaatatcagaaaaatattcgcattcatgctttcaacgaagagggcatggagccgtatccgcacggctgggatgtgtggagcaacggcatcaaaaagtttatggctgaaaaggggattcagccggacctgatctacacctcggaagaagccgatgcgccacagtatatggaacatctggggatcgatacggtgctggtcgatccgaaacgtacctttatgagtatcagcggtgcgcagatccgcgaaaacccgttccgctactgggaatatattcctacggaagtgaagccgttctttgtacgtaccgtggcgatccttggtggcgagtcgagcggtaaatccaccctggtaaacaaacttgccaatatcttcaataccaccagtgcgtgggaatatggtcgcgattatgtcttttcacacctcggcggtgatgagatcgcattgcagtattccgattacgataaaatcgcgctgggccacgcacaatacattgattttgcagtgaaatatgccaataaagtggcgtttattgacactgattttgtcactacccaggcgttctgcaaaaagtacgaagggcgtgagcatccgttcgtacaggcgttgattgatgaataccgtttcgatctggtgatcctgctggagaacaacacgccgtgggtggcggatggtttacgcagcctcggcagttcggtggatcgcaaagagttccagaacttgctggtggagatgctggaagagaacaatatcgaattcgtgcgggttgaagaggacgattatgacagccgtttcctgcgctgcgtggagctggtgcgggagatgatgggggagcagagataaccgcgatgaaacggctcaaaggcgaggtataaaataagttttttgatgagttgaaaacctctctggaagaggctgtcgagattaaacaaggtttgaaaaaacctgcacgggtgacccgctacgaaattgcggatactaaggctgttgtaggccggaaaaggcgttcacgccgtatccggcattcggtgctcaatgcctgatgcgacgcttaccgcgtcttatcaggcctggagattcacaacgtattgaaatttcttggtttgtaggccggataaggcgttcacgccgcatccggcattttacgcattacttcgcaatacgcttgtacttgatacgcttcggctccagtgcgtctgcgcccagcgtgcgtttcttgtactcttcgtactcagtaaagttaccttcgaagaactcaactttaccttcatcctggtagtccaggatgtgcgtggcgatacggtcgaggaaccaacggtcgtgcgagataaccatcgcacagcccgggaactccagcagggcgttttccagcgcgcgcagggtttcgatatccaggtcgttggttggttcgtcgagcagcagcatgttgccgccaacctgcagcagcttcgccagatgcagacgaccgcgctcaccaccggaaagttcaccaacgcgtttaccctgatcaacccctttaaagttaaagcggccaacgtaggcgcggcttggcatctcggtgttgccgatcttcataatatccagcccgccggaaacttcttcccaaacggttttgctgttatccattgagtcacggaactgatcaaccgatgccagtttcaccgtttcacctaaagtgatggtgccgctgtccggctgttcctgaccagagatcatacggaacagggtcgatttacccgcgccgttcggaccgatgatcccgacgattgcccctttcgggatcgagaagctcaggtcatcaatcagcaggcgatcaccgtaggatttacgcaggttgctgacttccagcactttatcgcccagacgcggtccaggtggaataaacagttcgttggtttcgttacgtttctgatattcggtgctgttcagctcttcaaagcgtgccagacgtgctttacctttcgactggcggcctttagttccctgacgtacccactccagctctttctcgatcgacttacgacgcgccgcttcttgtgaagcttcctgcgccaggcgctgatctttctgctccagccaggaggagtagttgccttcccacggaataccttcaccgcggtcaagttcgaggatccagcctgcaacgttatcgaggaagtaacggtcgtgggtaatcgccaccacggtgccctcgaagtcgtgcaggaagcgttccagccaggccacggattcggcatccaggtggttggtcggttcgtcgagcagcagcatgtctggtttttccagcagcaggcggcacaacgctacgcgacgacgctcaccaccggagaggttagcgattttcgcgtcccagtccggcagacgtagcgcatccgccgcacgctccagctgtacgttcaggttatgaccgtcgtgagcctgaatgatctcttccagacggccttgttcagcggccagcttgtcaaaatcggcatccggatcggcgtacagcgcatacacttcatccaggcgtttcagggcgttaaccacttcagaaaccgcttcttcaatggactcacgcacggtgtgttccgggttcagctgcggttcctgcggcagataaccaatcttgatgtctggctgcggacgtgcttcaccttcgatgtctttatcaatgcccgccataatgcgcagcagggtagacttacccgcgccgttcagacccaggacaccaatttttgccccagggaagaaactcagagagatgtttttcaaaatatgacgtttcggcggaacaactttgccgacacgatgcatggtataaacgaattgagccacgttggacttcgcctctatgtttatcgtgatgatgagttttcaaaggcgaagtgtagcctttttccccgcctaatcccagttggtcgatcaccttcgcagtaaaagtaaaaaagtgtccgtaacgtggcgtaaacggcaatgactggttagcataaatctattacgcggcatgacgctgcattgatgtatttacacttagaggatgcgcttgtggaaaaagccaaacaagttacctggcggctgttggctgccggtgtctgtctgctgacggtcagcagcgtggcgcgagccgactcactggatgagcagcgtagtcgttacgcgcaaatcaagcaggcctgggataatcgacaaatggatgtggtcgaacaaatgatgcctggactgaaggattatccgctttatccctacctggaataccgccagatcaccgatgatctgatgaatcaaccggcggtgacggtcactaactttgttcgcgctaaccccacgcttcctcccgctcgcacgctgcaatctcgtttcgtcaatgaactggcgcggcgtgaagactggcgtggcttgttagcctttagcccggaaaagcccggaactaccgaagcgcaatgtaattactactatgcgaaatggaacaccgggcagagtgaagaagcctggcaaggggcgaaagagctgtggctaaccggcaagagccagcctaatgcctgtgacaagttatttagcgtctggcgtgcgtcaggtaaacaagatccgctggcgtatttagagcgtatccgtctggcgatgaaagcgggtaacactggcctggtaacagtgctggcagggcagatgcctgccgattaccagactatcgcctcggcaatcatttcactggcgaacaaccctaatacggtactgaccttcgcgcgtacaaccggcgcgaccgattttacccgtcaaatggcagcggtggcgtttgccagtgtggcgcggcaggatgctgaaaatgcacggctgatgatcccgtcgcttgcccaggcgcagcagcttaatgaagatcagattcaggagctgcgcgatatcgtcgcctggcgtttgatgggcaacgatgtcaccgacgagcaggcgaaatggcgcgatgacgccattatgcgctcgcaatccacgtcgttgattgaacgccgtgtgcgaatggcacttggcaccggcgatcgtcgcggcctgaatacctggctggcgcgtctgccgatggaagcaaaagagaaagatgaatggcgttactggcaggcggatttattgctggaacgcggacgtgaagctgaagcgaaagagattttgcatcaactcatgcaacagcgtggtttctacccgatggttgcagcacaacgcatcggagaagagtatgagctgaagattgataaagcgccgcagaatgttgacagcgccctgactcaggggccggagatggcgcgcgtgcgcgagttgatgtactggaatctcgataacaccgcgcgtagcgagtgggccaatctggtgaagagcaagtcaaaaacagagcaggctcaactggctcggtatgctttcaataaccaatggtgggatcttagcgttcaggcaacgatcgccgggaagctttgggatcatctggaagagcgattcccgctggcttacaacgatcttttcaaacgttacaccagtgggaaagagatcccgcaaagctatgcgatggcgattgcccgtcaggagagcgcctggaatccgaaagtgaaatcaccggtaggggccagcggcctgatgcagattatgcctggtacagcgacccatacggtgaagatgttctctattcctggttatagcagccctgggcaattgctggatccggaaacgaatatcaacattggcaccagttacctgcaatatgtttatcagcagtttggcaataaccgtattttctcctcagcagcttataacgccggacctggacgggtgcgaacctggcttggcaacagcgccgggcgtatcgacgctgtggcatttgtcgagagtattccgttctccgagacgcgcggttatgtgaagaacgtgctggcttatgacgcttactaccgctatttcatgggggataaaccgacgttgatgagcgccacggaatggggacgtcgttactgatccgcacgtttatgatatgctatcgtactctttagcgagtacaaccgggggaggcattttgcttcccccgctaacaatggcgacatattatggcccaacaatcaccctattcagcagcgatggcagaacagcgtcaccaggagtggttacgttttgtcgacctgcttaagaatgcctaccaaaacgatctccatttaccgttgttaaacctgatgctgacgccagatgagcgcgaagcgttggggactcgcgtgcgtattgtcgaagagctgttgcgtggcgaaatgagtcagcgtgagttaaaaaatgaactcggcgcgggcatcgcgacgattacgcgtggatctaacagcctgaaagccgcgcccgtggagctgcgccagtggctggaagaggtgttgctgaaaagcgattgattttgtaggcctgataagacgcggcagcgtcgcatcaggcgcttaatacacggcattatgaaacggactcagcgccaggatcaccgcctggtgatagacgctggcgcgagtgagtttcccggcggtaaacacgccgatcgccccttccttacgaccaatctcatcaataccggtataacgcgacatcacgggaccaagcgcctcaccttcacgcactttctgcagaatcaccgcaggtaacggcaaagtagccgaacgcgcctcgccgcgctggctggtgttttcaatcaccacccaactgaaagtgctgtcaccatcgatgccagcttcaatcgccacccaaaaatcagcctctggaagtaaacggcgggcatttgctacccgatttcgtgcgccagcgcgcgtttcctcactgccaaagggctgttccggtacaccgctctcgacggcaacggatgcaatatggcaggatccttcgccgaagatctcgtgaaatgcctgcagaatggcctgaattttagcgggattggtggtcgcacagacaacttggtgcataatcagcattactcagaaaattaacgttacagcagtatacggaaaaaaagcatgttacaggtatacctagtccgccacggtgaaacgcagtggaacgccgagcgacgtattcagggccagtctgacagcccgctgaccgccaaaggtgagcaacaggcgatgcaggtggcaacccgtgccaaagagcttggcattacgcatattatcagtagcgatttaggacgcacccggcgtacggcggaaatcatcgcccaggcctgcggctgtgacatcatctttgattctcgcctgcgtgaattaaacatgggtgtgctggaaaaaagacatatcgattctctgaccgaagaagaagagaactggcgtcggcagctggtcaatggcaccgttgacgggcgtattcctgaaggcgagtcaatgcaggagctcagcgatcgcgtcaatgcggcactggaatcttgccgggacttaccgcagggaagccgaccgctgctggtgagccatggtattgcactgggatgtctggtgagtacgattctcggattaccagcatgggcagagcgccgcttacgtctgcgtaactgttctatttcgcgcgtggattatcaggaaagcctgtggctggcgtctggctgggtcgttgaaaccgcaggggacatctcgcatctggacgcccctgcattagatgagctgcagcgttaacggcggataggaatcagcagttcacagcgcagattaattgggcgatctcccgctttggcgtcttctgccgggtagtatcgctcaatatcctgacctttacggcgcgtcaggttgagcattggcatgcacgttccgtataccgtcaggataaactcctgcacgccggttcccagaccttcataggtaaacatcacatattcgccgccctgcagcatcaccggatgccccgtcagtacatagccatctgcctgatcctgggctaacgcggtggtatagaatacctcttgttcgtcgtctttatcctgactcggacgcgtttcattcaggccgtagagcactggcggaatggtcggcgcgttgccgagaaaatcgtgccagaactgataacgcatttcatggcggaaatcagagatttgctccagcgaacaggagtagctctgggtaacaccaatcagcggcgtatcttccagggtgacaaatttgtgctctggcattgtgaattcacccagacgtagcggcgggcgaataccaaaggcgctccattcaggagaacggcggtaaagtgcaggagtctgggcaaactgcttcttgaatgcgcgggtaaatgtctgttgagagtcgaagcggtattgcagcgcgatgtccagaatcggacgcgcagtcaggcgtagtgcgaccgccgatttcgacaaacgacgagcacgaatatacgcgccaatagcatggccagtgacatctttaaacattctctgtaagtgccacttggaataacctgctttcgccgctacattgtcgagcgacaggggctgatccagatgaccttccagccagattaaaaggtcgcgaataatgccggcctgatccataaaatatcctcatcctttcaacaacgagcacctgacatcaggtaattggataatagcattttttgctgttttagcattcagtgtttttttcttagtagagtatgttttagggcttgacggaaataaaagtattgagattttgttcttaatcaatatgttatttaccgtgacgaactaattgctcgtgtaatagataaaaatggtaacaatatgaaatacaagcatttgatcctgtctttaagcctgataatgctggggccattggctcatgcagaagagattggttcggtcgacaccgtatttaaaatgatcggcccggatcacaaaattgttgtggaagcctttgacgatcccgatgtgaaaaatgtcacctgttatgtgagccgggcgaaaaccgggggtattaaagggggattgggcctggcggaagatacctccgatgcggccatttcttgtcagcaagtcgggccgattgaactgtcggatcgtattaaaaacggcaaagctcagggcgaggtagtattcaaaaaacgcacgtccctggtctttaagtcgttacaggtcgtgcgcttttatgacgccaaacgcaacgcgctcgcttatctggcttactccgacaaagttgtagaaggttcgccgaaaaacgcgattagcgcggttcctgtcatgccgtggcggcaataacagaggcgatttatgcaacgggaaacggtctggttagtggaagatgagcaagggatagccgacacgctggtctacatgttgcagcaggaaggttttgccgtcgaggtctttgagcgaggcttaccggtgctggataaagctcgccagctggttcccgacgtcatgattctcgacgttggtttgcctgatatcagcggctttgaattgtgccgccagttactggcgctccatccggcgttacctgtactgttcctgacggcccgaagtgaagaggtcgatcgcctgcttgggctggaaattggcgctgacgactatgtggctaaaccgttttcaccccgcgaagtgtgcgccagggtgcgcaccttactgcgtcgggtgaagaagttctcgtcgccgtctcccgtcatccgtattggtcattttgaattgaatgaacccgcggcgcagatcagctggtttgacacgccattaacgctgacgcggtatgagtttttattgctgaagacgttactcaagtcgccaggccgcgtctggtcccgccagcaactgatggatagcgtgtgggaagatgcgcaggacacctacgatcgcaccgttgatacccacattaaaacgttgcgtgccaagctgcgcgccatcaaccccgatctttcaccgattaatactcatcgcggcatgggatatagcctgaggggcctgtaatgcgtatcggcatgcggttgctgctgggctattttttactggtggcggtggcggcctggttcgtactggctatttttgtcaaagaagttaaaccgggcgtgcgaagagcaacggaggggacgttgatcgacaccgcaacgttgctggcggagctggcgcgtcccgatttgctctctggggacccaacgcatgggcaactggcgcaggcgtttaatcagctacaacatcgcccgtttcgcgccaatatcggtggcattaacaaagtgcgcaatgaatatcatgtctatatgaccgattcgcagggtaaagtattgttcgattcggcaaataaagccgttgggcaggattattcgcgctggaatgacgtctggctaacgttgcgtggtcagtatggtgcgcgcagcacgttgcaaaatcctgccgatcccgaaagttcggtgatgtatgttgccgcgccgattatggacggctcgcggcttattggcgttttgagcgtaggcaaaccgaacgcggcgatggctccggtcattaaacgcagcgagcggcgaattttatgggccagcgccattttgttggggatcgcactggtgattggcgcaggcatggtttggtggatcaaccgctccattgcccggctcactcgctatgctgattccgtcactgacaataagcccgttcctcttcccgatctcggtagtagcgagctgcgtaaactcgcgcaggcgctggaaagtatgcgcgtgaagctggaagggaaaaactatattgagcagtatgtttatgcgttaacccatgagctaaaaagcccactggcggcgattcgtggcgcggcggaaattttacgcgaaggtccgccgcctgaagtagtggctcgttttactgacaacattctgacgcaaaatgcgcgaatgcaggcactggtggaaacgttactacgccaggcaagactggagaatcgtcaggaagtcgttttgactgctgttgatgtggcggcattattccgccgcgtcagcgaagcgcgcaccgtgcagttggcagaaaaaaacatcactctacatgttacgcccaccgaggttaatgttgctgctgaaccggcgttactggatcaggcgctggggaatttactggataacgccatcgattttacccccgagagcggtcgtataacgctaagcgccgaagtggatcaggaacacgtcacgcttaaggtgctggataccggtagtggtattcctgactacgcgctgtcacgtatttttgaacgcttttactctttgccgcgtgcaaatgggcaaaaaagcagcggtctggggttggcgttcgtcagtgaggtcgcccgtttgtttaacggcgaagtcacgctgcgcaacgtgcaggaaggtggcgtgctggcctcgcttcgacttcaccgtcacttcacatagcttcaaattcttcccacatagccttcgtatcctgctgccattgcaaaggagaagactatgttgaaatcccccctgttctggaaaatgaccaccctgtttggtgcagtattgctgttgttgattccgataatgctgattcggcaggtgattgtcgaacgtgccgattaccgtagcgatgtggaagatgcgattcgccaaagtaccagcgggccgcaaaaactcgttgggccgcttatcgctattcctgtgaccgagctttatacggtacaggaagaggataaaaccgtggagcggaaacgaagttttatccatttttggttacctgagtcattgatggttgatggcaatcagaacgtggaagaacgcaagatagggatttataccggtcaggtctggcacagtgatttaacgctaaaagccgatttcgatgtttcgcgtcttagcgaactcgacgcgccaaatatcacctttggcaagccatttattgtgattagcgtcggggatgcgcgtggtattggtgtggtgaaagcgcctgaagttaacggaacggcgctgaccattgaacccggcaccgggttagagcaaggcgggcagggcgtgcatatccctttacccgaaggggactggcggaagcagaacctgaagctgaatatggccctgaatttaagcggtaccggcgatctttctgtggtgcctgccgggcgtaatagcgaaatgaccttaaccagcaactggccgcatcccagttttttaggtgattttttgccagccaaacgggaagttagcgagtcaggttttcaggcgcaatggcaaagcagctggtttgctaataatctcggtgagcgttttgcttcaggcaatgataccggctgggaaaacttccccgcgtttagcgtcgcagtgacgacgccagccgatcaataccaaataacggaccgggcgactaagtacgccattctgctgattgcactgacttttatggcgttctttgtttttgaaacgctcaccgcgcaacgtttacacccaatgcaatatttgctggtggggctttcattggtgatgttttatttgctcttgctggcgctttctgaacatatcggttttaccgtggcatggataatcgccagtctgattggggcgttaatgaacggtatttatttgcaggcggtattgaaaggctggcgcaacagcatgttgtttaccctcgcgctgttgttgctggatggtgtgatgtggggactgctcaactctgccgatagcgcgctgttgttgggaaccagtgtgctggtggtggcgctggccggcatgatgtttgtgactcgtaatatcgactggtatgcgttttcactgccgaaaatgaaagccagtaaagaagttacaatggacgatcaattacgtatctggaaataaggttgaaaaataaaaacggcgctaaaaagcgccgttttttttgacggtggtaaagccgattaatcttccagatcaccacagaagcgataaccttcaccgtggatggtggcgatgatttccggcgtatccggcgtagattcgaaatgtttacgaatacggcggatcgtcacgtctacagtacggtcgtgtggtttcagctcacggccggtcattttcttcagcagttcagcacgagactgaattttgcctgggttttcacagaagtgaagcatggcgcggaactcgctgcgcggcagcttgtactgctcgccatcagggccgatcaacgaacggctgttgatgtccagttcccaaccattgaacttgtagctttcaacgctacgacgttcttcgctgacagtacccagattcatggtacgggacagcaggttgcgtgcacgaatcgtcagttcacgcgggttgaacggtttggtgatgtagtcatctgcaccgatttcgaggccgagaattttatcgacttcgttgtcacggccagtcaggaacatcaacgcaacattcgcctgctcgcgcagttcacgcgctaacagaagaccgttcttacccggcagattgatatccatgatcaccaggttgatgtcatattcagagaggatctgatgcatttccgcgccatctgtcgcttcgaaaacatcatagccttccgcttcgaaaatacttttcaacgtgttgcgtgttaccaactcgtcttcaacgataagaatgtgcggggtctgcatgtttgctacctaaattgccaactaaatcgaaacaggaagtacaaaagtccctgacctgcctgatgcatgctgcaaattaacatgatcggcgtaacatgactaaagtacgtaattgcgttcttgatgcactttccatcaacgtcaacaacatcattagcttggtcgtgggtactttccctcaggacccgacagtgtcaaaaacggctgtcatcctaaccattttaacagcaacataacaggctaagaggggccggacacccaataaaactacgcttcgttgacatatatcaagttcaattgtagcacgttaacagtttgatgaaatcatcgtatctaaatgctagctttcgtcacattattttaataatccaactagttgcatcatacaactaataaacgtggtgaatccaattgtcgagatttattttttataaaattatcctaagtaaacagaaggatatgtagcattttttaacaattcaaccgttagtacagtcaggaaatagtttagccttttttaagctaagtaaagggctttttctgcgacttacgttaagaatttgtaaattcgcaccgcgtaataagttgacagtgatcaccctgttcgcggttatttggtcaagaagagtggcaatatgcgtataacgattattctggtcgcacccgccagagcagaaaatattggggcagcggcgcgggcaatgaaaacgatgggttttagcgaactgcggattgtcgatagtcaagcgcacctggagccagccacccgctgggtcgcacatggatctggtgatattattgataatattaaagttttcccgacactggttgaatcgttacacgatgtcgatttcactgtcgccaccactgcgcgcagtcgggcgaaatatcattactacgccacgccagtagaactggtgccgctgttagaggaaaaatcttcatggatgagccatgccgcgctggtgtttggtcgcgaagattccgggctgactaacgaagagttagcgttggctgacgttcttactggtgtgccgatggtggcggattatccttcgctcaatctggggcaggcagtgatggtctattgctatcaattagcaacattaatacaacaaccgacgaaaagtgacacaacggcagaccaacatcaactgcaagctttacgcgaacgagtcatggcattgctgacgactctggcagtggcagatgacataaaactggtcgactggttacagcaacgcctggggcttttagagcaacgagacacggcaatgttgcaccgtttgctgcatgatattgaaaaaaatatcaccaaataaaaaacgccttagtaagtatttttc
